US012653908B2

(12) United States Patent
Michalakis et al.

(10) Patent No.: US 12,653,908 B2
(45) Date of Patent: Jun. 16, 2026

(54) METHOD OF TRANSACTIVATING A HOMOLOGOUS GENE OF A GENE OF INTEREST AND AN IN VITRO METHOD OF DIAGNOSING A DISEASE

(71) Applicant: VIGENERON GMBH, Planegg (DE)

(72) Inventors: Stylianos Michalakis, Munich (DE); Elvir Becirovic, Munich (DE); Lisa Riedmayr, Munich (DE); Victoria Splith, Munich (DE); Sybille Böhm, Munich (DE); Martin Biel, Starnberg (DE)

(73) Assignee: VeonGen Therapeutics GmbH, Planegg (DE)

( * ) Notice: Subject to any disclaimer, the term of this patent is extended or adjusted under 35 U.S.C. 154(b) by 1122 days.

(21) Appl. No.: 17/762,635

(22) PCT Filed: Sep. 23, 2020

(86) PCT No.: PCT/EP2020/076536
§ 371 (c)(1),
(2) Date: Mar. 22, 2022

(87) PCT Pub. No.: WO2021/058543
PCT Pub. Date: Apr. 1, 2021

(65) Prior Publication Data
US 2022/0409744 A1    Dec. 29, 2022

(30) Foreign Application Priority Data

Sep. 23, 2019    (EP) ..................................... 19198830
Aug. 18, 2020    (EP) ..................................... 20191613

(51) Int. Cl.
| | |
|---|---|
| *A61K 48/00* | (2006.01) |
| *A61P 27/02* | (2006.01) |
| *C12N 9/22* | (2006.01) |
| *C12N 15/11* | (2006.01) |
| *C12N 15/113* | (2010.01) |
| *C12N 15/86* | (2006.01) |
| *C12Q 1/6883* | (2018.01) |

(52) U.S. Cl.
CPC ........ *A61K 48/005* (2013.01); *A61K 48/0008* (2013.01); *A61P 27/02* (2018.01); *C12N 9/22* (2013.01); *C12N 15/111* (2013.01); *C12N 15/113* (2013.01); *C12N 15/86* (2013.01); *C12Q 1/6883* (2013.01); *C12N 2310/20* (2017.05); *C12N 2320/31* (2013.01); *C12N 2750/14143* (2013.01)

(58) Field of Classification Search
None
See application file for complete search history.

(56) References Cited

U.S. PATENT DOCUMENTS

2014/0377868 A1    12/2014    Joung et al.

FOREIGN PATENT DOCUMENTS

| WO | WO 2014/197748 | 12/2014 |
|---|---|---|
| WO | WO 2016/130600 | 8/2016 |

OTHER PUBLICATIONS

Burnight et al. "CRISPR-Cas9 genome engineering: Treating inherited retinal degeneration," Progress in Retinal and Eye Research, 2018, vol. 65, pp. 28-49.
Hu et al. "Direct activation of human and mouse Oct4 genes using engineered TALE and Cas9 transcription factors," Nucleic Acids Research, 2014, vol. 42, No. 7, pp. 4375-4390 (with Supplementary Information) 35 pages.
Splith et al. "Evaluation of reconstitution efficiencies of rAAV-dCas9-VPR split-intein protein trans-splicing vectors in retinal cells," Investigative Ophthalmology & Visual Science, Jul. 2018, vol. 59, No. 9, 5663, 2 pages.
Tost et al. "Engineering of the epigenome: synthetic biology to define functional causality and develop innovative therapies," Epigenomics, 2016, vol. 6, No. 2, pp. 153-156.
Williams et al. "VPS35, the Retromer Complex and Parkinson's Disease," Journal of Parkinson's Disease, 2017, vol. 7, pp. 219-233.
International Search Report and Written Opinion for International (PCT) Patent Application No. PCT/EP2020/076536, dated Nov. 25, 2020, 13 pages.

*Primary Examiner* — Allison M Fox
*Assistant Examiner* — Marisol Ann O'Neill
(74) *Attorney, Agent, or Firm* — Sheridan Ross P.C.

(57) ABSTRACT

The present invention relates to a method of trans-activating a homologous gene of at least one gene of interest and optionally deactivation of at least one gene of interest, wherein the mRNA encoded by the at least one gene of interest comprises a mutation compared to a control, and wherein the method comprises the steps as described in the present application. The present invention further relates to an in vitro method of diagnosing a disease, wherein the method comprises the steps of: a) Inducing the expression of the mRNA encoded by at least one gene of interest in a cell or tissue sample obtained from a subject; b) isolating the mRNA of step a); c) analyzing the sequence of the isolated mRNA of step b) and d) thereby detecting a mutation of the mRNA compared to a control, which is indicative for the presence of the disease.

11 Claims, 28 Drawing Sheets
Specification includes a Sequence Listing.

gene product A ≅ gene product B
in structure and function

METHOD OF TRANSACTIVATING A HOMOLOGOUS GENE OF A GENE OF INTEREST AND AN IN VITRO METHOD OF DIAGNOSING A DISEASE

CROSS REFERENCE TO RELATED APPLICATIONS

This application is a national stage application under 35 U.S.C. 371 and claims the benefit of PCT Application No. PCT/EP2020/076536 having an international filing date of 23 Sep. 2020, which designated the United States, which PCT application claimed the benefit of European Patent Application No. 19198830.2 filed 23 Sep. 2019 and European Patent Application No. 20191613.7 filed 18 Aug. 2020, the disclosures of each of which are incorporated herein by reference in their entireties.

REFERENCE TO SEQUENCE LISTING

This application contains a Sequence Listing submitted as an electronic text file named "PCT_Sequence_listing_AS_FILED.TXT", having a size in bytes of 766000 bytes, and created on 23 Sep. 2020. The information contained in this electronic file is hereby incorporated by reference in its entirety pursuant to 37 CFR § 1.52(e)(5).

FIELD OF THE INVENTION

The present invention relates to a method of trans-activating a homologous gene of at least one gene of interest and optionally deactivation of at least one gene of interest, wherein the mRNA encoded by the at least one gene of interest comprises a mutation compared to a control, and wherein the method comprises the steps of:—Binding of a complex comprising a native or genetically modified DNA-binding protein, at least one trans-activating domain of a transcriptional activator or transcription factor and at least one guideRNA, wherein the at least one guideRNA binds to the promoter region of the homologous gene of the at least one gene of interest or to other elements regulating the expression of the mRNA encoded by the homologous gene of the at least one gene of interest, optionally wherein a further guideRNA binds to the coding region, the promoter region and/or to other elements regulating the expression of the mRNA encoded by the at least one gene of interest; and, wherein the at least one gene of interest is selected from the group consisting of opsin genes, cyclic nucleotide-gated channel (CNG) genes, retinal-specific ATP-binding cassette transporter (ABC transporter) genes and myosin genes; —inducing the expression of the mRNA encoded by the homologous gene of the at least one gene of interest; and; —optionally deactivating the expression of the mRNA encoded by the at least one gene of interest; and—thereby trans-activating of the at least one gene of interest. Further, the present invention relates to an in vitro method of diagnosing a disease, wherein the method comprises the steps of: a) Inducing the expression of the mRNA encoded by at least one gene of interest in a cell or tissue sample obtained from a subject; b) isolating the mRNA of step a); c) analyzing the sequence of the isolated mRNA of step b) and d) thereby detecting a mutation of the mRNA compared to a control, which is indicative for the presence of the disease.

BACKGROUND OF THE INVENTION

Inherited retinal dystrophies (IRDs) comprise a heterogeneous group of blinding disorders affecting several millions of patients worldwide. Most of these blinding diseases are accompanied by functional or structural impairment of light detecting photoreceptor cells. These cells consist of night vision mediating rods and daylight and color vision mediating cones.

Retinitis pigmentosa (RP) represents the most common hereditary retinal disorder and primarily affects the rod photoreceptors (Daiger et al., 2013). By contrast, achromatopsia (ACHM) is among the most frequent genetic diseases affecting the cones (Michalakis et al., 2017). Many genes associated with RP or ACHM encode for members of the light-induced signaling transduction cascade (referred to as phototransduction cascade) in rods or cones. These photoreceptor cell types share functional properties, which are often mediated by homologous proteins encoded by distinct genes. For instance, the key signaling molecules in rods and cones, such as the visual pigments (opsins) or cyclic nucleotide-gated (CNG) channels are encoded by distinct yet highly homologous genes. While rods only express the rhodopsin gene (RHO), human cones contain three different cone opsin types (long wavelength L-opsin (OPN1LW), middle wavelength M-opsin (OPN1MW) and short wavelength S-opsin (OPN1SW)). Other than humans and primates, most other mammals including mice express only two types of cone opsins, the S-opsin (Opn1sw) and M-opsin (Opn1mw). CNG channels are heterotetrameric complexes composed of two different subunit types: The channel function-defining CNG A and the modulatory CNG B subunit. The native rod CNG channels contain CNGA1 and CNGB1, and their cone counterparts CNGA3 and CNGB3 subunits, respectively. Previous studies have shown that rod and cone CNG A subunits can also form functional units with the CNG B subunits from the other photoreceptor type (CNGA1/CNGB3 and CNGA3/CNGB1) (Finn et al., 1998). Many more examples of homologous genes crucially involved in vision detection and/or processing exist in photoreceptor and non-photoreceptor cells, like retinal pigment epithelial (RPE) cells.

Recent work on mouse models has shown that rhodopsin and cone opsins are also functionally equivalent (Fu et al., 2008, Kefalov 2012, Sakurai et al., 2007, Shi et al., 2007). This suggests that activation of genes encoding for cone opsins in rods could compensate for the defective rhodopsin in the respective mouse model. The same holds true for rod and cone CNG channel subunits, which have been shown to functionally compensate each other in heterologous expression systems (Finn et al., 1998, Gerstner et al., 2000, Sautter et al., 1998).

Mutations in the rhodopsin gene (RHO) are the leading cause for autosomal dominant RP (adRP). By comparison, mutations in genes encoding for cone CNG channel subunits (CNGA3 and CNGB3) are the most frequent cause for ACHM. Mouse models lacking rhodopsin (Rho−/−) or Cnga3 (Cnga3−/−) strongly reflect the clinical phenotypes of adRP and ACHM, respectively (Biel et al., 1999, Humphries et al., 1997).

In the past decades, many different approaches have been developed to counteract IRDs, such like RP or ACHM (Scholl et al., 2016). From the clinical perspective, currently the most popular gold standard approach is the classical gene supplementation therapy, which has been successfully applied on different mouse models for retinal degeneration (Boye et al., 2013, Koch et al., 2012, Michalakis et al., 2010). In all these studies recombinant adeno-associated virus (rAAV) vectors were used for efficient delivery and long-term expression of the respective gene in the retina. AAVs are small parvovirus-derived viruses, which serve as vehicles for the delivery of correct copies of the gene of interest. Although AAVs offer many advantages (i.e. high transduction efficiency, long-term expression without genomic integration, no or very low toxicity, good immune tolerance) they also harbor some important drawbacks, which impede their broader application in classical gene supplementation therapies. One important drawback of rAAV vectors is their limited genome packaging capacity (approx. 4.7 kb including the promoter and the inverted terminal repeats (ITRs) (Wu et al., 2010)). Many IRDs, however, are caused by genes whose coding sequences by far exceed the packaging limit of AAVs, such as USH2A, MYO7A, ABCA4, CACNA1F, CDH23, GPR98, EYS, RP1 or PRPH8. As such, there is an unmet need for developing strategies to overcome this important limitation of AAVs.

One pioneering method for treatment of genetic diseases is the CRISPR (clustered regularly interspaced short palindromic repeats)/Cas9 genome editing technology. The DNA—targeting endonuclease Cas9 can be recruited to specific loci within the genome by means of short complementary RNA molecules referred to as guide RNAs (gRNAs). In previous work, to further widen the range of application of the Cas9 enzyme, endonuclease-deficient Cas9 variants (referred to as "dead" Cas9, dCas9) have been developed (Sander & Joung 2014, Wang et al., 2016)). Among other things, the application spectrum of these modified Cas9 variants includes the efficient activation of genes in vitro and in vivo (Sander & Joung 2014). For this purpose, the dCas9 is C-terminally fused to trans-activating domains of transcription factors. In a recent study, the efficiencies of different CRISPR/Cas9 gene activation domains have been compared for several genes in a variety of different cell types. In this context, one specific gene activating domain (VPR, hybrid VP64-p65-Rta tripartite activator (Chavez et al., 2015)) was shown to result in highest gene activation efficiencies throughout all experiments and across all species tested. In addition, this study also demonstrated that the binding position of gRNAs in the promoter region of the respective gene influences the efficiency of gene activation. Finally, it was also shown that an increased number of gRNAs ameliorates gene activation (Chavez et al., 2016).

However, although very promising and powerful in vitro, the therapeutic application of the dCas9 VPR approach in retinal and other tissues is hampered by the lack of efficient delivery techniques. Due to its size (5.8 kb) dCas9-VPR by far exceeds the DNA packaging capacity of rAAV vectors. In the past, several approaches have been developed to circumvent this limitation of rAAVs (Chamberlain et al., 2016, Flotte 2000). These approaches are based on pre- or posttranscriptional reconstitution of split rAAV transgenes on DNA, mRNA or protein level.

More than 60 different IRD genes have been identified so far. Although gene diagnostics have substantially improved, there is still a very large number (up to 40%) of IRD patients without confirmed genetic diagnosis (Audo et al., 2012, Shanks et al., 2013). Potential reasons for this lack of genetic diagnosis could be technical limitations or that the patient carries pathogenic mutations in an unknown gene. Additionally, among the autosomal recessive IRD patients with no confirmed genetic diagnosis, there is a high percentage carrying only one mutation in a single gene, e.g. in key genes associated with Leber congenital amaurosis (LCA), Usher syndrome (USH) or Stargardt disease (STGD). These patients most likely carry a second mutation in non-coding regions of the same gene, which were not detected by the standard diagnostic panels.

The next generation sequencing techniques, such as whole genome sequencing (WGS) or whole exome sequencing (WES), have facilitated the diagnostics of genetic diseases. Both, WGS and WES, however, also have key limitations. WES does not cover the non-exonic regions (introns, promoter or other regulatory transcriptional elements), which are crucial for mRNA stability and/or processing. WGS is still costly in terms of both time and money and the interpretation of the big data obtained during this process is challenging and has to be done by trained bioinformaticians. Even in case potential disease-causing mutations can be identified in exonic or non-exonic regions of candidate genes using WGS, experimental validation of how these mutations might impact on mRNA level is inevitable.

Single nucleotide variants can affect mRNA via different mechanisms. Among those, the most common mechanism is the alteration of mRNA splicing (Baralle & Buratti 2017, Kim et al., 2018). The classical splice mutations are those affecting the consensus sequences of known splice sites. These mutations are usually detected via the methods described above (WGS and/or WES) and classified as splice mutations using standard splice prediction software. Nevertheless, excepting those affecting the first two intronic nucleotides flanking the exons (GT for AG), the classification of mutations as splice mutations usually requires experimental validation on mRNA level in affected cells or in minigene-based assays expressing the corresponding gene fragments in commonly available cell lines. Apart from false positive results, the splice prediction software might also yield an uncertain number of false negative records. Typically, these "false-negative" splice mutations are located in deep exonic coding regions, where splice prediction is rather challenging (Grodecka et al., 2017, Ohno et al., 2018). Regularly, (deep) exonic point mutations predicted to affect conserved and/or functionally important amino acids are classified as missense variants. However, irrespective of their type, disease-causing mutations could also lead to aberrant splicing, a largely unexplored option. Additionally, identifying splice mutations is also important in context of developing appropriate treatment options for the affected individuals. As splice mutations linked to IRDs can e.g. be treated using antisense oligonucleotides (Bergsma et al., 2018, Godfrey et al., 2017), the identification of such mutations will also have a strong impact on the development of future therapies.

Taking advantage of WGS, some publications identified deep intronic (splice) mutations in IRD patients (Bax et al., 2015, Braun et al., 2013, Carss et al., 2017, Khan et al., 2017, Liguori et al., 2016, Mayer et al., 2016, Naruto et al., 2015, Rio Frio et al., 2009, Vache et al., 2012, Webb et al., 2012). However, as explained above, the experimental validation of these mutations on mRNA level is rather sophisticated and therefore hardly applicable to a large number of patients.

In a recent publication, the potential effects of two deep intronic variants in the ABCA4 gene on mRNA splicing were analyzed in photoreceptor precursor cells induced from patients' fibroblasts (Albert et al., 2018). This procedure has two key limitations: i) It is elaborate and time consuming and thus hardly applicable for routine diagnostics; ii) the induced precursor cells do not express all IRD-genes, rendering them unsuitable for genetic diagnosis of many IRD patients.

Taken together, there is an unmet need for developing improved and easily applicable techniques, which enable the investigation of pathogenic gene mutations on transcript level. The most convenient way to analyze the transcripts of the corresponding genes is to use patients' tissue. However, biopsies (e.g. retinectomy) is often not reasonable and many disease genes are expressed in a tissue-specific manner (e.g. most IRD-linked genes are only expressed in retinal cells), but not expressed in easily accessible cells (e.g. blood cells, fibroblasts or cell found in urine).

The technology presented in this invention enables to circumvent these obstacles by inter alia a dCas9-VPR-based trans-activation approach to activate single (or multiple) genes in patient's cells and to examine the corresponding mRNAs for pathogenic changes via targeted RNA sequencing and/or via the classical RT-PCR analysis.

In this invention, the inventors introduce trans-activation of (homologous) genes using dCas9-VPR for therapeutic (see FIG. 1) as well as diagnostic (see FIG. 2) applications for overcoming the above mentioned disadvantages and for fulfilling the desired needs.

SUMMARY OF THE INVENTION

The present invention relates to a method of trans-activating a homologous gene of at least one gene of interest and optionally deactivation of at least one gene of interest, wherein the mRNA encoded by the at least one gene of interest comprises a mutation compared to a control, and wherein the method comprises the steps of:—Binding of a complex comprising a native or genetically modified DNA-binding protein, at least one trans-activating domain of a transcriptional activator or transcription factor and at least one guideRNA, wherein the at least one guideRNA binds to the promoter region of the homologous gene of the at least one gene of interest or to other elements regulating the expression of the mRNA encoded by the homologous gene of the at least one gene of interest, optionally wherein a further guideRNA binds to the coding region, the promoter region and/or to other elements regulating the expression of the mRNA encoded by the at least one gene of interest; and, wherein the at least one gene of interest is selected from the group consisting of opsin genes, cyclic nucleotide-gated channel (CNG) genes, retinal-specific ATP-binding cassette transporter (ABC transporter) genes and myosin genes; —inducing the expression of the mRNA encoded by the homologous gene of the at least one gene of interest; and; —optionally deactivating the expression of the mRNA encoded by the at least one gene of interest; and—thereby trans-activating of the at least one gene of interest. The optional deactivation of at least one gene of interest is preferably the deactivation of the at least one gene of interest of which the homologous gene has been trans-activated, but also encompasses deactivation of at least one further gene of interest. Wherein the gene of interest and the further gene of interest is a gene whose function is impaired due to a mutation or in other words wherein the mRNA encoded by the gene of interest comprises a mutation.

In one embodiment of the method of trans-activating, the method further comprises inducing the expression of the protein encoded by the mRNA of the homologous gene of the at least one gene of interest and analyzing the sequence, the expression level, the localization or the function of at least one protein encoded by the mRNA.

In one embodiment of the method of trans-activating, the homologous gene of the at least one gene of interest is selected from the group consisting of ABCA1 (SEQ ID NO: 1), ABCA2 (SEQ ID NO: 3), ABCA7 (SEQ ID NO: 7), ABCA12 (SEQ ID NO: 9), ABCA13 (SEQ ID NO: 11), CNGA1 (SEQ ID NO: 13), CNGA2 (SEQ ID NO: 15), CNGA3 (SEQ ID NO: 17), CNGA4 (SEQ ID NO: 19), CNGB1 (SEQ ID NO: 21), CNGB3 (SEQ ID NO: 23), MYO7B (SEQ ID NO: 33), MYO5A (SEQ ID NO: 25), MYO5B (SEQ ID NO: 27), MYO5C (SEQ ID NO: 29), MYO10 (SEQ ID NO: 35), MYO15B (SEQ ID NO: 39), MYO15A (SEQ ID NO: 37), OPN1LW (SEQ ID NO: 41), OPN1MW (SEQ ID NO: 43) and OPN1SW (SEQ ID NO: 45).

In one embodiment of the method of trans-activating, the native or genetically modified DNA-binding protein is selected from the group consisting of Cas-enzymes; preferably Cas9 (SEQ ID NO: 92), dCas9-enzymes (SEQ ID NO: 96, SEQ ID NO: 97), Cas12a (SEQ ID NO: 93) or Cas12b (SEQ ID NO: 94); zinc-finger nucleases; and transcription activator-like nucleases; and/or wherein the at least one trans-activating domain of a transcriptional activator or transcription factor is selected from the group consisting of VPR (SEQ ID NO: 89), SAM (SEQ ID NO: 90), SunTag (SEQ ID NO: 91), VP64 (SEQ ID NO: 73), p65 (SEQ ID NO: 74), Rta (SEQ ID NO: 75) or combinations thereof; preferably wherein the nucleotide sequences of the native or genetically modified DNA-binding protein and of the at least one trans-activating domain of the transcriptional activator or transcription factor are separated in two split fragments. More preferably, the native DNA-binding protein is the Cas9 enzyme of *Streptococcus pyogenes* (SEQ ID NO: 92). More preferably, the genetically modified DNA-binding protein is selected from the group consisting of dCas9 with mutations D10A and H840A according to SEQ ID NO: 96 and dCas9 with mutations D10A, D839A, H840A and N863A according to SEQ ID NO: 97. However, in principle all Cas enzymes of any known organism can be used within this method of the present invention.

In one embodiment of the method of trans-activating, the nucleotide sequences of the native or genetically modified DNA-binding protein and of the at least one trans-activating domain of the transcriptional activator or transcription factor are on two separate plasmids and/or vectors.

In one embodiment of the method of trans-activating, the method further comprises the use of recombinant AAV vectors of natural or engineered origin, preferably AAV vector variants with retinal cell type tropism and enhanced retinal transduction efficiency.

The invention further provides a complex comprising a native or genetically modified DNA-binding protein, at least one trans-activating domain of a transcriptional activator or transcription factor and at least one guideRNA for use in a method of treating an inherited retinal dystrophy (IRD) due to a mutation in at least one gene of interest selected from the group consisting of opsin genes, cyclic nucleotide-gated channel (CNG) genes, retinal-specific ATP-binding cassette transporter (ABC transporter) genes and myosin genes, the method comprising trans-activating a homologous gene of the at least one gene of interest and optionally deactivation of the at least one gene of interest (e.g., wherein the mRNA encoded by the at least one gene of interest comprises a mutation compared to a control); wherein the at least one guideRNA binds to the promoter region of the homologous gene of the at least one gene of interest or to other elements regulating the expression of the mRNA encoded by the homologous gene of the at least one gene of interest; optionally wherein a further guideRNA binds to the coding region, the promoter region and/or to other elements regulating the expression of the mRNA encoded by the at least one gene of interest; and wherein the expression of the mRNA encoded by the homologous gene of the at least one gene of interest is induced; and optionally the expression of the mRNA encoded by the at least one gene of interest is deactivated; wherein preferably the complex is provided as nucleotide sequences of the native or genetically modified DNA-binding protein, the at least one trans-activating domain of a transcriptional activator or transcription factor and the at least one guide RNA, optionally wherein the nucleotide sequences of the native or genetically modified DNA-binding protein and of the at least one trans-activating domain of the transcriptional activator or transcription factor are on two separate plasmids and/or vectors, preferably wherein the two separate vectors are recombinant AAV vectors. The AAV vectors may be of natural or engineered origin, more preferably the AAV vectors may be AAV vector variants with retinal cell type tropism and/or enhanced retinal transduction efficiency.

The invention further comprises an in vitro method of diagnosing a disease, wherein the method comprises the steps of: a) Inducing the expression of the mRNA encoded by at least one gene of interest in a cell or tissue sample obtained from a subject; b) isolating the mRNA of step a); c) analyzing the sequence of the isolated mRNA of step b) and d) thereby detecting a mutation of the mRNA compared to a control, which is indicative for the presence of the disease.

In one embodiment of the in vitro method of diagnosing a disease, the method further comprises inducing the expression of the protein encoded by the mRNA and analyzing the sequence, the expression level, the localization or the function of the at least one protein encoded by the mRNA in the cell or tissue sample.

In one embodiment of the in vitro method of diagnosing a disease, step a) comprises specific binding of a complex comprising a native or genetically modified DNA-binding protein and at least one trans-activating domain of a transcriptional activator or transcription factor to the promoter region of the at least one gene of interest or to other elements regulating the expression of the at least one gene of interest.

In one embodiment of the in vitro method of diagnosing a disease, the native or genetically modified DNA-binding protein is selected from the group consisting of Cas-enzymes; preferably Cas9 (SEQ ID NO: 92), dCas9-enzymes (SEQ ID NO: 96, SEQ ID NO: 97), Cas12a (SEQ ID NO: 93) or Cas12b (SEQ ID NO: 94); zinc-finger nucleases (ZFN); and transcription activator-like nucleases (TALEN). More preferably, the native DNA-binding protein is the Cas9 enzyme of *Streptococcus pyogenes* (SEQ ID NO: 92). More preferably, the genetically modified DNA-binding protein is selected from the group consisting of dCas9 with mutations D10A and H840A according to SEQ ID NO: 96 and dCas9 with mutations D10A, D839A, H840A and N863A according to SEQ ID NO: 97. However, in principle all Cas enzymes of any known organism can be used within this method of the present invention.

In one embodiment of the in vitro method of diagnosing a disease, the native or genetically modified DNA-binding protein is a Cas-enzyme; preferably Cas9 (SEQ ID NO: 92), dCas9-enzymes (SEQ ID NO: 96, SEQ ID NO: 97), Cas12a (SEQ ID NO: 93) or Cas12b (SEQ ID NO: 94); and wherein the complex further comprises at least one guideRNA, which is able to bind to the promoter region of the at least one gene of interest or to other elements regulating the expression of the at least one gene of interest.

In one embodiment of the in vitro method of diagnosing a disease, the DNA-binding protein is C- or N-terminally fused to the at least one trans-activating domain of the transcriptional activator or transcription factor, preferably wherein the at least one trans-activating domain of a transcriptional activator or transcription factor is selected from the group consisting of VPR (SEQ ID NO: 89), SAM (SEQ ID NO: 90), SunTag (SEQ ID NO: 91), VP64 (SEQ ID NO: 73), p65 (SEQ ID NO: 74), Rta (SEQ ID NO: 75) or combinations thereof.

In one embodiment of the in vitro method of diagnosing a disease, the disease is a neurodegenerative disease, epilepsy, psychological diseases; preferably depression, mania, bipolar disorder, schizophrenia or autism; or a retinal disease, preferably an inherited retinal dystrophy, more preferably wherein the inherited retinal dystrophy is selected from the group consisting of age-related macular degeneration (AMD), genetically caused age-related macular degeneration (AMD), autosomal dominant, autosomal-recessive, X-linked or digenic retinitis pigmentosa, achromatopsia, Stargardt disease, Best disease, Leber's congenital amaurosis, retinoschisis, congenital stationary night blindness, choroideremia, early-onset retinal dystrophy, cone, rod-cone or cone-rod dystrophy, pattern dystrophies, Usher syndrome and other syndromic ciliopathies, even more preferably Bardet-Biedl syndrome, Joubert syndrome, Senior-Løken syndrome or Alström syndrome.

BRIEF DESCRIPTION OF THE FIGURES

FIG. 1A shows that Gene A is active in a given cell type or tissue, but is defect due to (a) disease-causing mutation(s). Gene B is a gene A homolog and is very similar to gene A in both, structure and function, but is not expressed (inactive) in the affected cell type/tissue. FIG. 1B shows the trans-activation therapy, which aims at activating gene B in the appropriate tissue (or cell type) using the dCas9-VPR module in combination with gene B specific guide RNAs (gRNA). Gene B then compensates the missing (gene A) function and provides a therapeutic benefit to the patient. TSS means transcriptional start site.

FIG. 3A is a scheme showing the hybrid VP64-p65-Rta tripartite activator (dCas9-VPR, SEQ ID NO: 95). VP64 (SEQ ID NO: 73) is a transcriptional activator composed of four tandem copies of VP16 (Herpes Simplex Viral Protein 16) connected with glycine-serine linkers. dCas9-VPR (SEQ ID NO: 95) consists of dCas9 fused to the activation domains VP64 (SEQ ID NO: 73), p65 (SEQ ID NO: 74), and Rta (SEQ ID NO: 75) with each activation domain being separated by a short amino acid linker. FIG. 3B shows binding positions (in bp) of the single Cnga1 specific gRNAs (g1-g3) (target sequence of g1-g3 in Cnga1 (SEQ ID NOs: 76-78) including PAM sequence) relative to the transcriptional start site (TSS) within the mouse Cnga1 promoter (black arrow). The promoter and TSS were obtained from the http://epd.vital-it.ch/mouse/mouse_database.php website. FIG. 3C shows a doxycycline inducible cassette expressing dCas9-VPR (SEQ ID NO: 95) together with Cnga1 gRNAs (VPR-A1, upper panel) (target sequences of g1-g3 in Cnga1 (SEQ ID NO: 76-SEQ ID NO: 78) including PAM sequence) or lacZ (VPR-lacZ, lower panel) gRNAs (target sequence in lacZ (SEQ ID NO: 125) including PAM sequence). Each gRNA is driven by a U6 promoter. FIG. 3D shows representative results of 661w cells expressing one of the cassettes shown in FIG. 3C and co-immunolabeled with a Cnga1 specific antibody. FIG. 3E and FIG. 3F show qRT-PCRs to quantify the Cnga1 (E) or dCas9 (F) mRNA levels in 661w cells expressing the VPR-A1 cassette in presence of different doxycycline concentrations as indicated. FIG. 3G-L show excised inside-out patch clamp recordings from 661w cells expressing VPR-A1 (CNGA1) or VPR-lacZ (LacZ) cassettes. FIG. 3G-J show absolute (FIG. 3G and FIG. 3I) and normalized (FIG. 3H and FIG. 3J) current changes obtained from the respective cells in presence of cGMP alone (FIG. 3G and FIG. 3H) and $Ca^{2+}/Mg^{2+}$ alone or in combination with cGMP (FIG. 3I and FIG. 3J). FIGS. 3K and 3L show representative traces from membrane patches of 661w cells expressing VPR-A1 (CNGA1, FIG. 3K) or VPR-lacZ (LacZ, FIG. 3L) under basal conditions, after addition of cGMP and/or $Ca^{2+}/Mg^{2+}$. Statistical analysis was done with the unpaired Student's t-test for comparisons between two groups. ***, $p < 0.001$.

FIG. 4A shows the schematic overview of the dCas9 split-intein variants used. Cas9 fragments were generated by splitting dCas9 either at aa position V713 (upper panel) or E573 (lower panel). The first dCas9 fragment (dCas9N1 or dCas9N2, numbered as 1 and 3, respectively) was fused C-terminally to the N-terminal part of the intein (IntN). The second Cas9 fragment (dCas9C1 and dCas9C2, numbered as 2 and 4, respectively) contains on its N-terminus the C-terminal intein half (IntC). Bp means base pairs. FIG. 4B shows the western blot from HEK293 cells transiently co-transfected with the single split-intein dCas9 combinations as indicated. A specific antibody against the N-terminal part of dCas9 was used for signal detection. FIG. 4C shows the semi-quantitative calculation of the split-Cas9 reconstitution efficiencies resulting from four independent transfection experiments shown in FIG. 4B. Reconstitution efficiencies were determined by calculating the intensity ratios of the reconstituted full length dCas9 band and the corresponding dCas9N1 or dCas9N2 bands for each lane. The mean reconstitution efficiency values are as follows: 1+2=56.9±2.1%; 3+4=33.3±1.1%. Statistical analysis was done with the unpaired Student's t-test for comparisons between two groups. ****, $p < 0.0001$.

FIG. 5A shows the full-length Cas9 cassette in combination with Cnga1 (A1), Opn1mw (O1mw) or Opn1sw (O1sw) gRNAs used for transient transfection of 661w cells (for Cnga1) or MEF cells (for Opn1mw and Opn1sw). The full-length Cas9 cassette in combination with a lacZ gRNA served as control (target sequence of gRNA in lacZ including PAM sequence: SEQ ID NO: 124). CMV means Cytomegalovirus promoter. FIG. 5B shows single V713_dC9 variants used for the transient co-transfection of the respective cells. The dCas9 fragments correspond to the dCas9N1 and dCas9C1 constructs shown in FIG. 4. FIG. 5C and FIG. 5D shows binding positions (in bp) of the single Opn1mw (C) or Opn1sw (D) specific gRNAs (g1-g3) (target sequences of g1-g3 in Opn1mw (SEQ ID NOs: 79-81) and Opn1sw (SEQ ID NOs: 83-85) including PAM sequence) relative to the transcriptional start site (TSS) within their promoters (black arrow). The promoter and TSS were obtained from the http://epd.vital-it.ch/mouse/mouse_database.php website. FIG. 5E-FIG. 5G shows qRT-PCR for determination of trans-activation efficiencies using full-length dCas9-VPR (SEQ ID NO: 95) (FIG. 5E, FIG. 5G and FIG. 5I) or V713_dC9 (FIG. 5F and FIG. 5H) for the single genes as indicated. Statistical analysis was done with the unpaired Student's t-test for comparisons between two groups. *, $p < 0.05$; , $p < 0.01$; *, $p < 0.001$; ****, $p < 0.0001$.

FIG. 6A shows single V713_dC9 AAV vector expression cassettes used for the co-transduction of rod photoreceptors. hRHO means human rhodopsin promoter. Wild type mice were subretinally injected at P14 using the AAV2/8 capsids. FIG. 6B-FIG. 6D shows immuno-labeling of mouse retinas three weeks post injection for injected (FIG. 6B and FIG. 6D) or sham-injected control eyes (FIG. 6C and FIG. 6E). A peanut agglutinin lectin (PNA) antibody was used as a cone photoreceptor marker. For staining of Opn1mw (SEQ ID NO: 44) and Opn1sw (SEQ ID NO: 46), specific antibodies were used described elsewhere (e.g. Becirovic et al., 2016, Nguyen et al., 2016). FIGS. 6F and 6G, qRT-PCR using RNA isolated from mice injected with V713_dC9 and Opn1mw or Opn1sw gRNAs (target sequences of g1-g3 in Opn1mw (SEQ ID NOs: 79-81) and Opn1sw (SEQ ID NOs: 83-85) including PAM sequence) expressing viruses three weeks post injection. Sham-injected eyes were used as controls (ctrl).

FIG. 7A, upper panel, shows statistics of the single ERG measurements for the three groups at different light intensities. n. s., not significant. Lower panel, Scotopic b-wave amplitudes were plotted against the light intensities. FIG. 7B shows optical coherence tomography performed on the same group of mice used for the ERGs shown in FIG. 7A. ONL means outer nuclear layer. All statistics were performed using ANOVA with Bonferroni's post-hoc test. *, $p < 0.05$; , $p < 0.01$; *$p < 0.001$.

FIG. 8A shows a scheme depicting the chromosome 1 q41 region where KCDT3 (SEQ ID NO: 109) and USH2A (SEQ ID NO: 49) genes are situated on the opposite strands ((+)—strand in case of KCDT3 (SEQ ID NO: 122) and (−)—strand in case of USH2A). Note the overlap in the 3'UTR of both genes. The transcriptional activation site is indicated by an arrow. FIG. 8B shows a not-to-scale scheme of the USH2A (SEQ ID NO: 49) transcript consisting of 72 exons (see boxes). The 5' and 3' UTR is shown at the ends of the scheme. Primers (SEQ ID NO: 98-SEQ ID NO: 121) used for amplification of the single USH2A (SEQ ID NO: 49) fragments are depicted as double arrows. The corresponding PCR products (a-l) are shown as lines including the fragment lengths in base pairs (bp). FIG. 8C shows RT-PCR from human fibroblasts transiently transfected with dCas9-VPR (SEQ ID NO: 95) in combination with USH2A gRNAs (left panel) (target sequences of gRNAs in USH2A (SEQ ID NOs: 86-88) including PAM sequences) or control lacZ gRNAs (target sequence in lacZ (SEQ ID NO: 125) including PAM sequences) (right panel) using the primer pairs shown in FIG. 8B. All PCR-products were amplified using the same PCR cycling conditions. Kb means kilo base pairs. The band in line I (right panel) corresponds to the 3' UTR of KCDT3 (SEQ ID NO: 122). The identity of the bands was evaluated by Sanger sequencing. FIG. 8D shows qRT-PCR from three independent experiments using human fibroblasts transfected with dCas9-VPR (SEQ ID NO: 95) in combination with lacZ (left) (target sequence in lacZ including PAM sequence: SEQ ID NO: 125) or USH2A (right) gRNAs (target sequences of gRNAs in USH2A (SEQ ID NO: 86-88) including PAM sequences). Data are shown as fold change of the mRNA transcript counts normalized to the housekeeping aminolevulinic acid synthase (ALAS). Statistics were done using the unpaired Students t-test. **, p=0.0033. Data are presented as mean±standard error of the mean (0.86±0.04 for dCas9-VPR_lacZ and 600.70±95.56 for dCas9-VPR_USH2A). Right panel depicts the binding position of the qRT-PCR primers in the USH2A transcript. qU2_for binds to exon 12 and qU2_rev to exon 13 as indicated.

Figure 1:
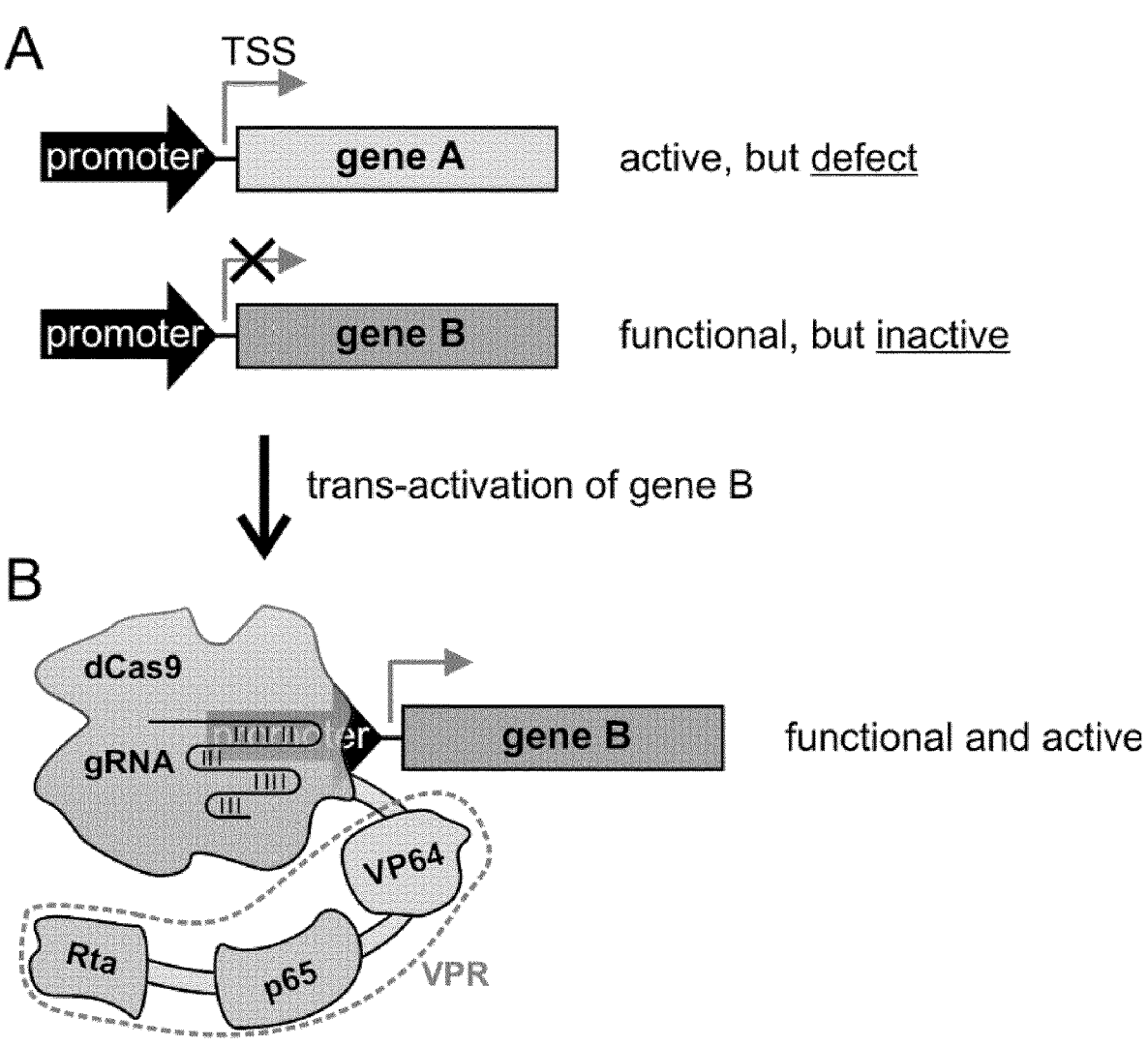
FIG. 1 shows the dCas9-VPR-mediated trans-activation of homologous genes as a novel treatment option of hereditary diseases.
Figure 2:
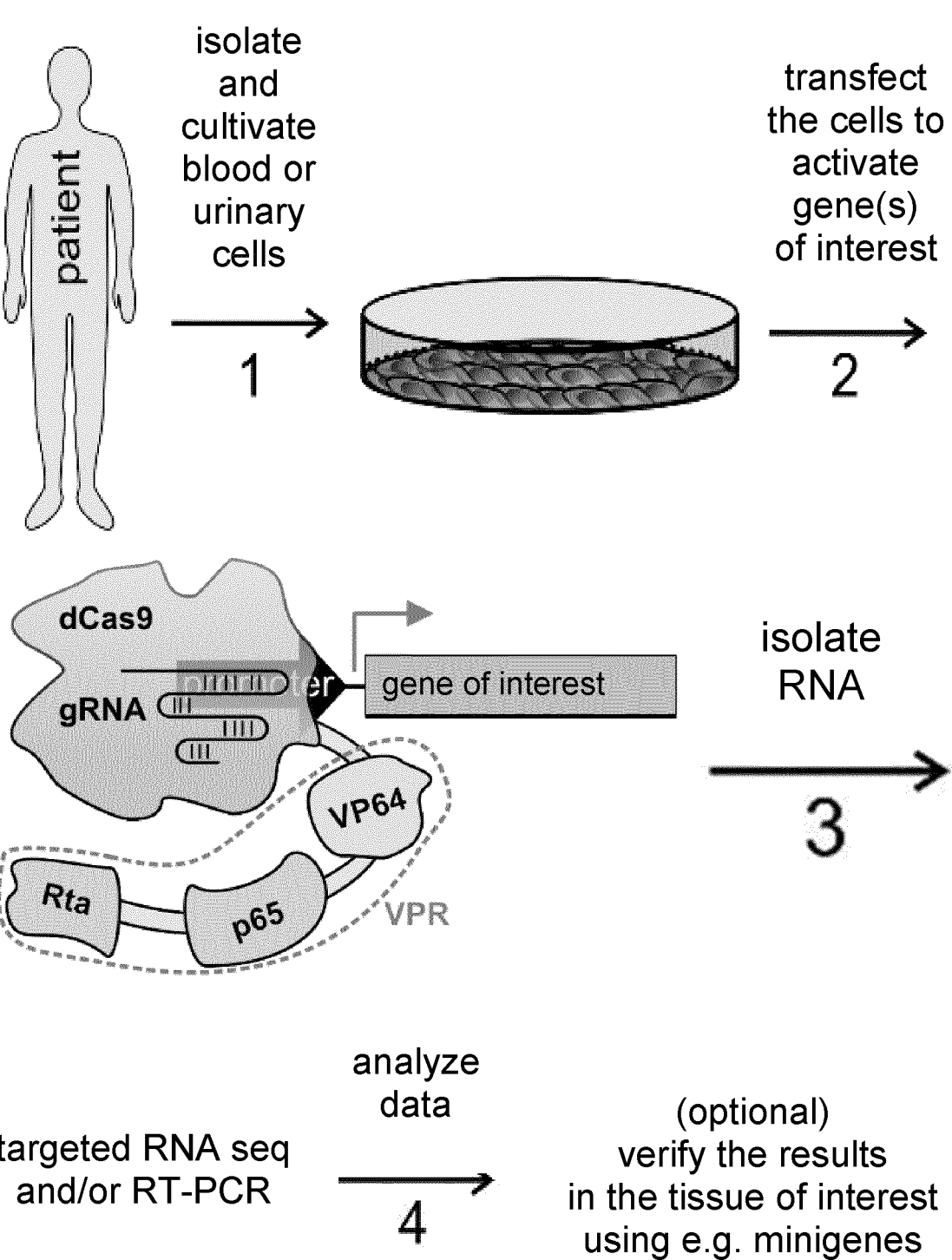
FIG. 2 shows gene trans-activation as a novel tool for diagnostic purposes.
Figure 3:
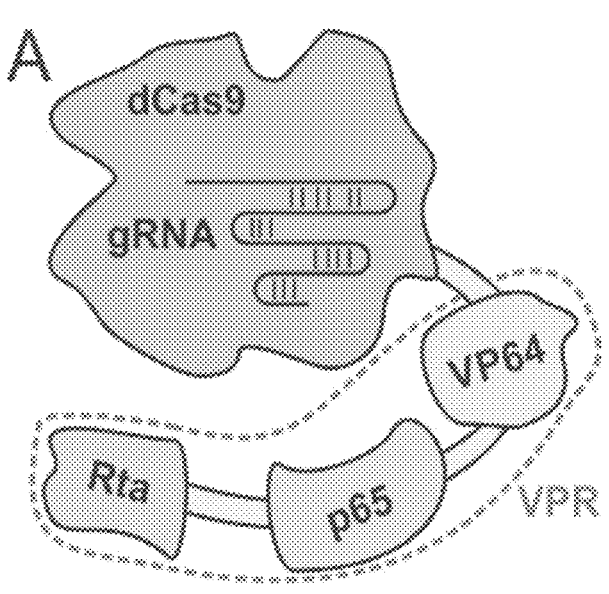
FIG. 3 shows dCas9-VPR-mediated trans-activation of mouse Cnga1 in 661w cells.
Figure 3:
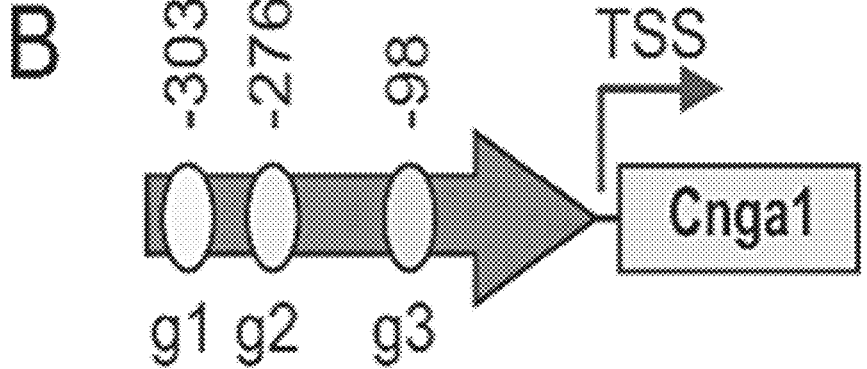
Figure 3:
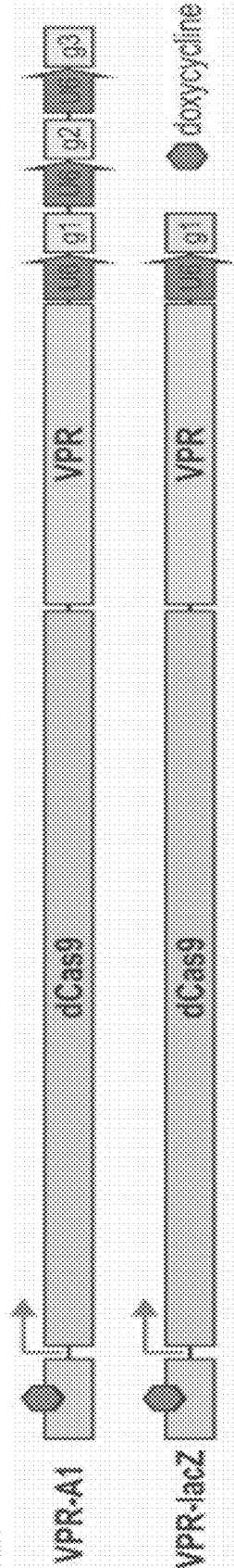
Figure 3:
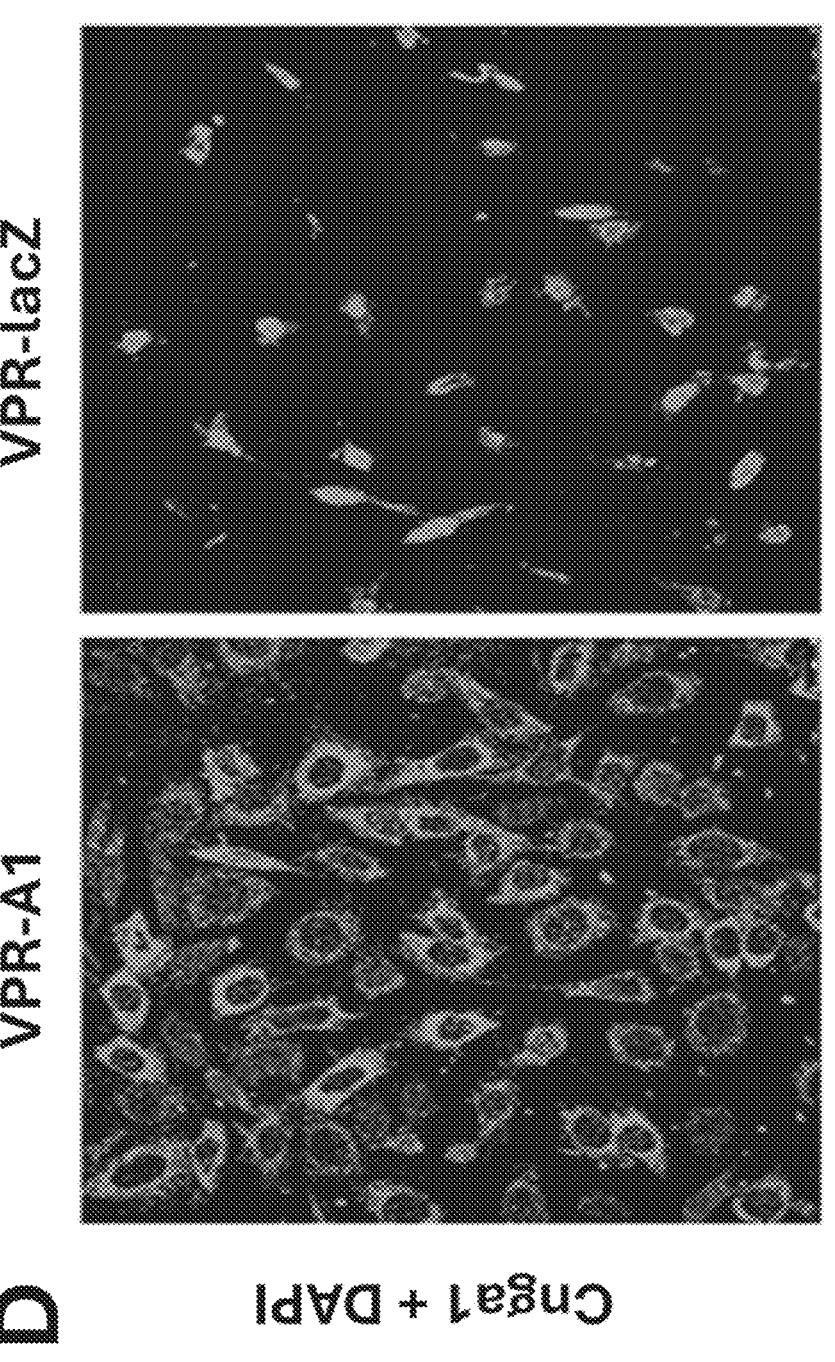
Figure 3:
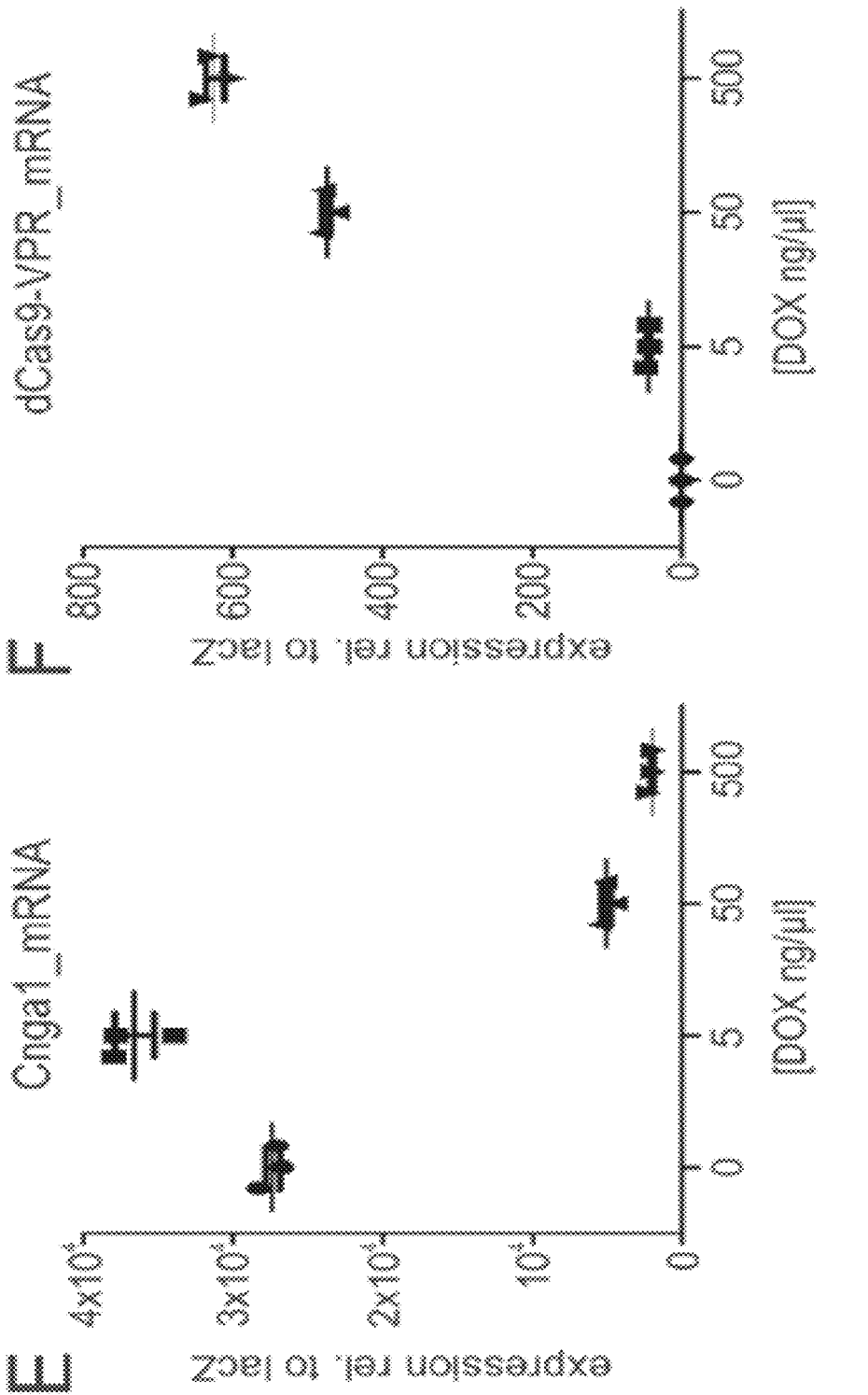
Figure 3:
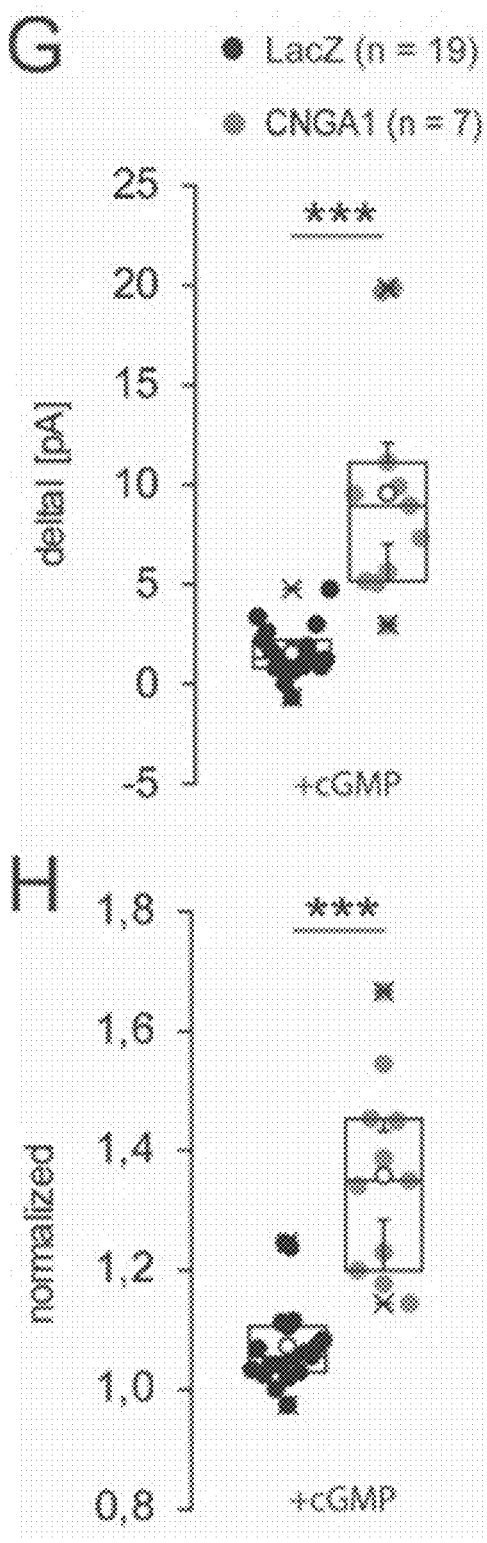
Figure 3:
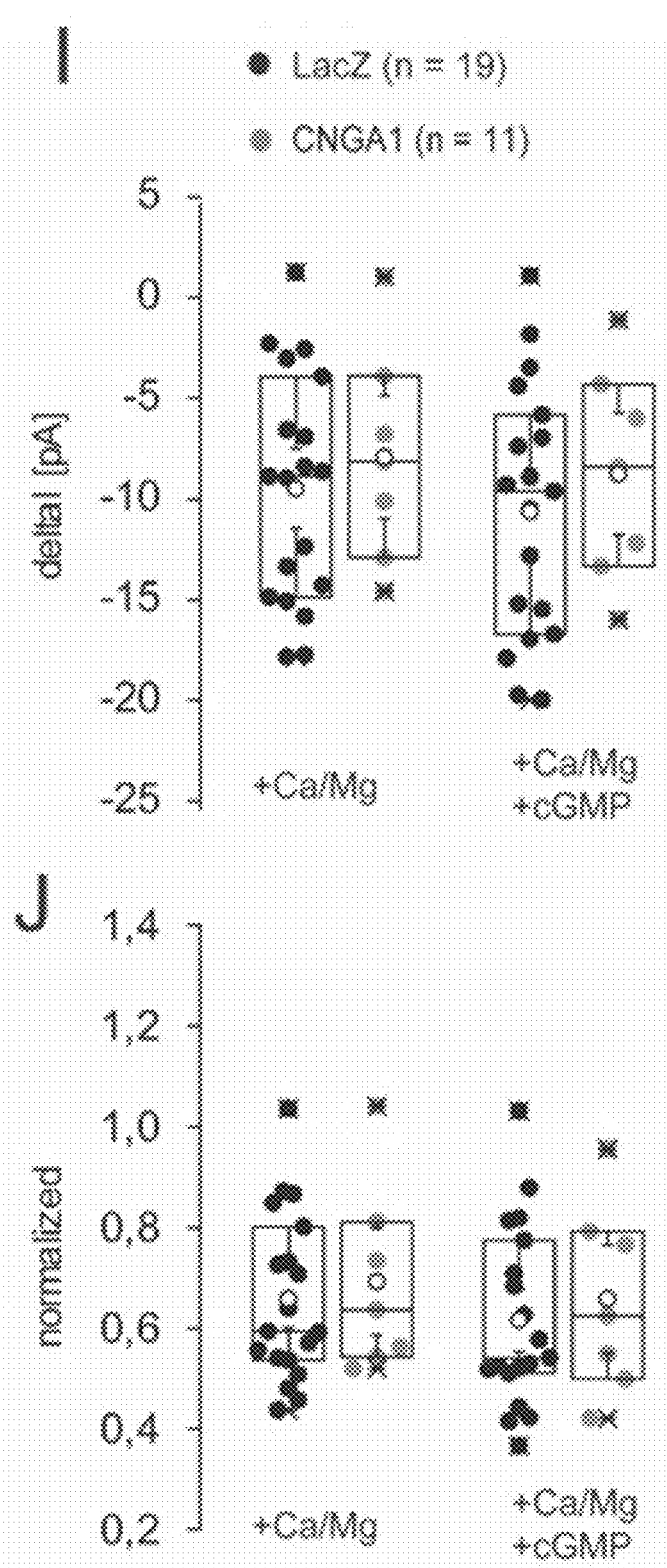

Statistical analysis was done with one-way ANOVA followed by the Bonferroni's post-hoc test for multiple comparisons. *; p<0.05; , p<0.01; *, p<0.001.

DETAILED DESCRIPTION OF THE INVENTION

The present invention relates to a method of trans-activating a homologous gene of at least one gene of interest and optionally deactivation of at least one gene of interest, wherein the mRNA encoded by the at least one gene of interest comprises a mutation compared to a control, and wherein the method comprises the steps of:—Binding of a complex comprising a native or genetically modified DNA-binding protein, at least one trans-activating domain of a transcriptional activator or transcription factor and at least one guideRNA, wherein the at least one guideRNA binds to the promoter region of the homologous gene of the at least one gene of interest or to other elements regulating the expression of the mRNA encoded by the homologous gene of the at least one gene of interest, optionally wherein a further guideRNA binds to the coding region, the promoter region and/or to other elements regulating the expression of the mRNA encoded by the at least one gene of interest; and, wherein the at least one gene of interest is selected from the group consisting of opsin genes, cyclic nucleotide-gated channel (CNG) genes, retinal-specific ATP-binding cassette transporter (ABC transporter) genes and myosin genes; —inducing the expression of the mRNA encoded by the homologous gene of the at least one gene of interest; and; —optionally deactivating the expression of the mRNA encoded by the at least one gene of interest; and—thereby trans-activating of the at least one gene of interest. The optional deactivation of at least one gene of interest is preferably the deactivation of the at least one gene of interest of which the homologous gene has been trans-activated, but also encompasses deactivation of at least one further gene of interest. Wherein the gene of interest and the further gene of interest is a gene whose function is impaired due to a mutation or in other words wherein the mRNA encoded by the gene of interest comprises a mutation.

"Transactivation" or "trans-activating", as used within the context of the present invention, relates to an increased rate of gene expression induced either by biological processes or by artificial means, through the expression of an intermediate transactivator protein such as the complex of the present invention. Thus, the term "transactivation of the gene of interest" always leads in the context of the present invention to a functional compensation of the defect/non-functional gene of interest, thereby enabling a treatment of the disease.

The term "gene", as used within the context of the present invention, means any nucleic acid sequence or portion thereof with a functional role in encoding or transcribing an RNA (rRNA, tRNA, or mRNA, the latter capable of translation as a protein) or regulating other gene expression. The gene may consist of all the nucleic acids responsible for encoding a functional protein or only a portion of the nucleic acids responsible for encoding or expressing a protein. The nucleic acid sequence may contain a genetic abnormality within exons, introns, initiation or termination regions, promoter sequences, other regulatory sequences or unique adjacent regions to the gene.

The term "gene of interest", as used within the context of the present invention, means a gene whose function is impaired due to a mutation and therefore is a target to be replaced in function by a homologous gene. The term "the mRNA encoded by the gene of interest comprises a mutation" as used herein refers to mutations in the mRNA sequence (nucleotide deletions, insertions and/or substitutions, preferably point mutations), but also encompasses alterations of the mRNA, such as an altered splice pattern (also referred to as splice mutation), reduced mRNA stability and/or reduced expression (compared to control), wherein the alteration of the mRNA is due to a mutation in the gene of interest. The mutation can be in the coding region or the non-coding region, such as in the promoter, an activating region and/or an intron (e.g. generating, modifying or eliminating a splice donor site or a splice acceptor site). Preferably, the mutation is a mutation in the coding region or a splice mutation. The function of the gene of interest may also be impaired due to chromosome ablation etc.

The term "homologous gene", as used within the context of the present invention, means a gene whose sequence, structure and/or function is identical or similar to a respective gene of interest and therefore may—after transactivation—replace or complement the function of the gene of interest.

The term "deactivation" or "deactivating", as used within the context of the present invention, means any operation at the gene such that the gene mediated function is inhibited. This may comprise that the gene activity is reduced or completely inactivated thereby. It includes, without being limited thereto, cutting the gene of interest.

The term "mRNA", as used within the context of the present invention, means a large family of RNA molecules called messenger RNA that convey genetic information from DNA to the protein translation carried out by the ribosomes. This means such an RNA is produced by transcription and carries the code for a particular protein from the nuclear DNA to a ribosome in the cytoplasm and acts as a template for the formation of the protein.

The term "mutation", as used within the context of the present invention, means any (pathogenic) alteration or permanent alteration (for example by a point mutation or frameshift mutation) in the nucleotide sequence of a gene. It includes nucleotide insertions, deletions or substitutions.

The term "complex", as used within the context of the present invention, means a whole composed of two or more parts. In the specific context of the present invention, the complex comprises a native or genetically modified DNA-binding protein, at least one trans-activating domain of a transcriptional activator or transcription factor and at least one guideRNA as defined elsewhere herein.

The term "native or genetically modified DNA-binding protein", as used within the context of the present invention, means any protein, which is able to bind to DNA. Such can be particularly in the context of the present invention, any Cas-enzymes of any known organism, zinc-finger nucleases or transcription activator-like nucleases (TALEN). Such a native DNA-binding protein may be the Cas9 enzyme of *Streptococcus pyogenes* (SEQ ID NO: 92). The term "genetically modified" may comprise in this specific context any alterations within the coding sequence of the DNA-binding protein, which alters the protein function, preferably its DNA editing properties, more preferably by impairing its DNA editing properties. Such genetically modified DNA-binding proteins may be dCas9 with mutations D10A and H840A according to SEQ ID NO: 96 and dCas9 with mutations D10A, D839A, H840A and N863A according to SEQ ID NO: 97.

The term "trans-activating domain of a transcriptional activator or transcription factor", as used within the context of the present invention, means any protein, domain or sequence in general, which has the ability to activate the expression of a factor or activator, which is responsible for the transcription of another sequence. For example, "trans-activating domain" includes, but is not limited to, VPR (SEQ ID NO: 89), SAM (SEQ ID NO: 90), SunTag (SEQ ID NO: 91), VP64 (SEQ ID NO: 73), p65 (SEQ ID NO: 74) or Rta (SEQ ID NO: 75).

The terms "transcriptional factor" and "transcription factor" are used synonymously herein and refer to a protein that allows transcription of a gene by binding to the promoter of the gene and recruitment of RNA polymerase. The transcription factor acts alone or in complex with other proteins, such as one or more transcriptional activator and/or a transcriptional repressor.

The term "guideRNA", as used within the context of the present invention, may be a sequence that targets the CRISPR/Cas9 complex to a specific position within the genomic DNA, preferably a promoter region of a specific gene. For example, a guideRNA may mean a sequence comprising two RNAs, i.e., CRISPR RNA (crRNA) and transactivating crRNA (tracrRNA) or may be a single-chain RNA (sgRNA) produced by fusion of an essential portion of crRNA and tractRNA. The sgRNA is composed of a proto-spacer that is complementary to the DNA, a tractRNA that stabilizes the complex and a linker sequence that connects these two parts together. To be recruited to the locus of interest (e.g. a promoter), the CRISPR/Cas9-guide RNA complex also requires the presence of a proto-spacer adjacent motif (PAM) in the corresponding locus sequence. The guide RNA may be transferred into a cell or an organism in the form of RNA or DNA that encodes the guide RNA. The guide RNA may be in the form of an isolated RNA, RNA incorporated into a viral vector, or is encoded in a vector. Preferably, the vector may be a viral vector, plasmid vector, or *agrobacterium* vector, but it is not limited thereto. A DNA that encodes the guide RNA may be a vector comprising a sequence coding for the guide RNA. For example, the guide RNA may be transferred into a cell or organism by transfecting the cell or organism with the isolated guide RNA or plasmid DNA comprising a sequence coding for the guide RNA and a promoter (e.g. U6 promoter).

The term "promoter region", as used within the context of the present invention, means a region of DNA that leads to initiation of transcription of a particular gene. Promoters are located near the transcription start sites of genes, upstream on the DNA (towards the 5' region of the sense strand). Promoters are typically composed of 100-1000 base pairs.

The term "other elements regulating the expression of the mRNA", as used within the context of the present invention, may be enhancers, silencers and/or boundary elements/insulators with regard to the expression of a respective RNA or mRNA.

The term "opsin genes", as used within the context of the present invention, means any gene of various colorless proteins that in combination with retinal or a related prosthetic group form a visual pigment (such as rhodopsin) in a reaction reversible by light. Such genes are, for example, the M-opsin gene (OPN1MW) (SEQ ID NO: 43), L-opsin gene (OPN1LW) (SEQ ID NO: 41) or S-opsin gene (OPN1SW) (SEQ ID NO: 45).

The term "cyclic nucleotide-gated channel (CNG) genes", as used within the context of the present invention, means any member of the CNG channel gene family, which—in vertebrates—consists of six members. These genes are divided based on sequence similarity into two subtypes CNGA and CNGB. Additional genes that code for CNG channels have been cloned from *Caenorhabditis elegans* and

US 12,653,908 B2

15

*Drosophila melanogaster.* A subunit of a CNG channel CNGA1, previously called the rod α subunit, was expressed in rod photoreceptors and produced functional channels that were gated by cGMP, when expressed externally in either *Xenopus* oocytes or in a human embryonic kidney cell line (HEK293). In humans, mutated CNGA1 genes result in an autosomal recessive form of retinitis pigmentosa, a degenerative form of blindness. CNGB1, previously called the rod β subunit, is a second subunit of the rod channel. Unlike CNGA1, CNGB1a subunits expressed alone do not produce functional CNG channels, but co-expression of CNGA1 and CNGB1a subunits produces heteromeric channels with modulation, permeation, pharmacology, and cyclic-nucleotide specificity comparable to that of native channels. CNG channels form tetramers, and recent studies indicate that native rod channels consist of three CNGA1 subunits and one CNGB1a subunit. CNGA3 subunits, previously called the cone α subunits, form functional channels in heterologous expression systems. On the other hand, CNGB3, previously called the cone β subunit, cannot form functional channels on its own. Mutations in human CNGA3 and CNGB3 are involved in complete achromatopsia, which is a rare, autosomal recessive inherited and congenital disorder characterized by the complete failure in color discrimination, reduced visual acuity and increased photophobia. Analogous to the stoichiometry of rod subunits, cone CNG channels are composed of three CNGA3 and one CNGB3 subunit. CNGA2, previously called the olfactory α subunit, CNGA4, previously called the olfactory β subunit, and CNGB1b are involved in transduction of odorant signals in olfactory sensory neurons. The olfactory CNG channels are composed of two CNGA2, one CNGA4 and one CNGB1b subunit.

The term "retinal-specific ATP-binding cassette transporter (ABC transporter) gene", as used within the context of the present invention, means any gene encoding a member of the ABC transporter family. This is a group of specific membrane proteins that use the hydrolysis of ATP to power the translocation of a wide variety of substrates across cellular membranes. ABC transporters minimally consist of two conserved regions: a highly conserved nucleotide-binding domain (NBD) and a less conserved transmembrane domain (TMD). Eukaryotic ABC proteins are usually organized either as full transporters (containing two NBDs and two TMDs), or as half transporters (containing one NBD and one TMD), that have to form homo- or hetero-dimers in order to constitute a functional protein. Retinal-specific ATP-binding cassette transporter ABCA4 (also known as the Rim protein, ABCR) is a eukaryotic protein belonging to the ABC-A subfamily of the ABC transporter family. In humans, ABCA4 is localized with opsin photo-pigments in outer segment disc membranes of rod and cone photoreceptor cells. It serves as an N-retinylidene-phosphatidylethanolamine and phosphatidylethanolamine importer. Mutations in the ABCA4 gene cause Stargardt disease (STGD1), a recessive disorder characterized by the loss in central vision, progressive bilateral atrophy of photoreceptor and retinal pigment epithelial (RPE) cells, accumulation of fluorescent deposits in the macula, and a delay in dark adaptation.

The term "myosin genes", as used within the context of the present invention, means genes encoding related proteins called myosins. Myosins are often referred to as molecular motors because they use energy to move. They can interact with actin. Actin proteins are organized into filaments to form a network (the cytoskeleton) that gives structure to cells and can act as a track for myosin to move along. Some myosin proteins attach (bind) to other proteins and transport them within and between cells along the actin track. Some myosins are involved in muscle contraction. These myosins interact with other myosin proteins, forming thick filaments. In muscle cells, thick filaments made up of myosin and thin filaments made up of actin compose structures called sarcomeres, which are the basic units of muscle contraction. The overlapping thick and thin filaments bind to each other and release, which allows the filaments to move relative to one another so that muscles can contract. Mutations in genes that encode muscle myosins can cause severe abnormalities in the muscles used for movement (skeletal muscles) or in the heart (cardiac) muscle. Cardiac muscle abnormalities can lead to heart failure and sudden death. Myosin proteins are involved in many cellular functions. Their ability to transport materials and create force through contractions makes them important in the process of cell division. Myosins are also involved in cell movement. Some myosins are found in specialized structures in the inner ear known as stereocilia. These myosins are thought to help properly organize the stereocilia. Abnormalities in these myosins can cause deafness. Examples of genes in this gene group are: MYH3, MYH6, MYH7, MYH9, MYH11, MYO5A, MYO5B and MYO7A. Mutations in the MYO7A gene cause Usher syndrome, the leading cause for genetic deaf-blindness worldwide. The patients suffer from a severe form of retinitis pigmentosa, congenital deafness and vestibular dysfunction (balancing problems).

The term "control", as used within the context of the present invention, relates to a gene of interest, which does not comprise any mutation leading to the respective disease, its presence is investigated by any of the methods according to the present invention. The genomes naturally differ between different subjects and therefore there is a certain deviation of the "wild type" sequences of the same genes between different subjects (of the same species). These differences usually do not alter the function of the gene. Thus, although there might be some differences with respect to the sequence, the function of the expression product of the gene of interest is not impaired. However, these differences do not include any mutation that can cause a disease. Such disease-linked mutations may include deletions or changes of single nucleotides but also of longer sections within the affected gene.

In one embodiment of the method of trans-activating according to the present invention, the method further comprises inducing the expression of the protein encoded by the mRNA of the homologous gene of the at least one gene of interest and analyzing the sequence, the expression level, the localization or the function of at least one protein encoded by the mRNA.

The term "expression level", as used within the context of the present invention, means any extent of expression of a specific sequence.

The term "localization of a protein", as used within the context of the present invention, means any method that enables to detect a specific protein. Such methods may comprise the use of localization signals. However, for the detection of protein localization specific antibodies are used in most cases (self-made, commercially available or imported elsewhere). The antibodies then recognize epitopes of the native protein. Recombinant proteins may also be tagged for better detection, which may then be recognized either by standard commercial antibodies (e.g., flag tag, His tag, or myc tag). Finally, you can equip the proteins to be examined with small fluorescent tags, which can then be easily detected by microscopic methods. As in the methods according to the present invention, natively occurring genes or proteins are activated, antibody-based methods for the detection of protein localization are suitable and preferred.

The term "function of a protein" or "protein function", as used within the context of the present invention, means any function that is mediated by a protein. There exist several schemes that categorize protein functions. Among them Gene Ontology (GO) and Functional Catalogue (FunCat) are two commonly used schemes that are based on general biological phenomena taking place in a wide variety of organisms and eukaryotes (Riley, 1998; Rison et al., 2000; Ouzounis et al., 2003).

The homologous gene can have a function that is identical or similar to the gene of interest and therefore may—after transactivation—replace or complement the function of the gene of interest. Examples for such homologous genes can be found in the following. Accordingly, in one embodiment of the method of trans-activating, the homologous gene of the at least one gene of interest is selected from the group consisting of ABCA1 (SEQ ID NO: 1), ABCA2 (SEQ ID NO: 3), ABCA7 (SEQ ID NO: 7), ABCA12 (SEQ ID NO: 9), ABCA13 (SEQ ID NO: 11), CNGA1 (SEQ ID NO: 13), CNGA2 (SEQ ID NO: 15), CNGA3 (SEQ ID NO: 17), CNGA4 (SEQ ID NO: 19), CNGB1 (SEQ ID NO: 21), CNGB3 (SEQ ID NO: 23), MYO7B (SEQ ID NO: 33), MYO5A (SEQ ID NO: 25), MYO5B (SEQ ID NO: 27), MYO5C (SEQ ID NO: 29), MYO10 (SEQ ID NO: 35), MYO15B (SEQ ID NO: 39), MYO15A (SEQ ID NO: 37), OPN1LW (SEQ ID NO: 41), OPN1MW (SEQ ID NO: 43) and OPN1SW (SEQ ID NO: 45).

The gene of interest in the context of the present invention is a gene whose function is impaired due to a mutation and therefore is a target to be replaced in function by a homologous gene. As outlined herein, the gene of interest and the homologous gene share the same or a similar function, but do not necessarily have the same sequence or structure. In one embodiment of the method of trans-activating, the at least one gene of interest is selected from the group consisting of Rhodopsin gene (RHO) (SEQ ID NO: 47), M-opsin gene (OPN1MW) (SEQ ID NO: 43), L-opsin gene (OPN1LW) (SEQ ID NO: 41) or S-opsin gene (OPN1SW) (SEQ ID NO: 45), ABCA4 (SEQ ID NO: 5), CNGA1 (SEQ ID NO: 13), CNGA3 (SEQ ID NO: 17), CNGB1 (SEQ ID NO: 21), CNGB3 (SEQ ID NO: 23), and MYO7A (SEQ ID NO: 31).

In one embodiment of the method of trans-activating according to the present invention, the at least one gene of interest is selected from the group consisting of M-opsin gene (OPN1MW) (SEQ ID NO: 43), L-opsin gene (OPN1LW) (SEQ ID NO: 41) and S-opsin gene (OPN1SW) (SEQ ID NO: 45).

Thus, some illustrative examples of relevant homologous gene pairs include ABCA4/ABCA1, CNGA1/CNGA3, CNGB1/CNGB3, GUCY2E/GUCY2F, GUCA1A/ GUCA1B, MYO7A/MYO7B. Given the functional and/or structural similarity of the respective homologous gene pairs, switching on of the respective homologous gene by transactivation in the affected cell type (cones, rods or RPE cells) will functionally compensate for the deficiency of the mutant gene.

As outlined herein, the underlying principle of the invention is the combination of a DNA binding protein with a transactivating domain. The DNA-binding protein may be native or genetically modified. The DNA-binding protein may be selected from the group consisting of Cas-enzymes, zinc-finger nucleases and transcription activator-like nucleases (TALENs). Because these native DNA-binding molecules may have the function of an endonuclease, they might be genetically modified to lose their function as endonuclease. Additionally, native Cas-enzymes may not have the function of an endonuclease, when the gRNA targeting sequence (protospacer) is shortened. In the present invention, the term "targeting sequence" describes the part of the guide RNA that directly binds to the target DNA. In combination, Cas9 with guide RNAs with targeting sequences of less than 16 base pairs, Cas9 is incapable of cutting the DNA and thus cannot function as an endonuclease.

Different trans-activating domains are known to a person skilled the art. These trans-activating domains include, but are not limited to, VPR (SEQ ID NO: 89), SAM (SEQ ID NO: 90), SunTag (SEQ ID NO: 91), VP64 (SEQ ID NO: 73), p65 (SEQ ID NO: 74) or Rta (SEQ ID NO: 75). These trans-activating domains may be fused to the DNA-binding protein. Thus, the DNA-binding protein directs the trans-activating domain to the homologous gene and thereby enables the transcription of the homologous gene. Accordingly, in one embodiment of the method of trans-activating, the native or genetically modified DNA-binding protein is selected from the group consisting of Cas-enzymes; preferably Cas9 (SEQ ID NO: 92), dCas9-enzymes (SEQ ID NO: 96, SEQ ID NO: 97), Cas12a (SEQ ID NO: 93) or Cas12b (SEQ ID NO: 94); zinc-finger nucleases; and transcription activator-like nucleases; and/or wherein the at least one trans-activating domain of a transcriptional activator or transcription factor is selected from the group consisting of VPR (SEQ ID NO: 89), SAM (SEQ ID NO: 90), SunTag (SEQ ID NO: 91), VP64 (SEQ ID NO: 73), p65 (SEQ ID NO: 74), Rta (SEQ ID NO: 75) and combinations thereof; preferably wherein the nucleotide sequences of the native or genetically modified DNA-binding protein and of the at least one trans-activating domain of the transcriptional activator or transcription factor are separated in two split-fragments. The application of split-fragment allows distributing the DNA-binding protein-transcriptional activator/factor fusion protein on the separate vectors. Each of these separate vectors is smaller and thereby could be incorporated in smaller viral particles that may be administered to the subject. Thus, in one embodiment of the method of trans-activating according to the present invention, the at least one trans-activating domain of the transcriptional activator or transcription factor are the trans-activating domains VP64 (SEQ ID NO: 73), p65 (SEQ ID NO: 74) and Rta (SEQ ID NO: 75), preferably the trans-activating domain of the transcriptional activator or transcription factor comprises or consists of a nucleotide sequence as set forth in SEQ ID NOs: 73, 74 and 75.

Cas9 (SEQ ID NO: 92) may be split at positions E573 or V713 for split intein mediated protein trans-splicing. However, any other position for splitting may also be conceivable within the context of any method of the present invention. Accordingly, in one embodiment of the method of trans-activating, the native or genetically modified DNA-binding protein is Cas9 (SEQ ID NO: 92) and the split nucleotide sequences, consisting of the nucleic acid sequence of the at least one trans-activating domain of the transcriptional activator or transcription factor and of the nucleic acid sequence of Cas9, are split at the positions E573 or V713 of dCas9, preferably one of the dCas9-enzymes according to SEQ ID NO: 96 or SEQ ID NO: 97.

In one embodiment of the method of trans-activating according to the present invention, the native or genetically modified DNA-binding protein is a Cas-enzyme, preferably Cas9 (SEQ ID NO: 92), dCas9-enzymes (SEQ ID NO: 96, SEQ ID NO: 97), Cas12a (SEQ ID NO: 93) or Cas12b (SEQ ID NO: 94); and the complex further comprises at least one guideRNA, which is able to bind to the promoter region of the homologous gene of the at least one gene of interest or to other elements regulating the expression of the homologous gene of the at least one gene of interest. More preferably, the native DNA-binding protein is the Cas9 enzyme of *Streptococcus pyogenes* (SEQ ID NO: 92). More preferably, the genetically modified DNA-binding protein is selected from the group consisting of dCas9 with mutations D10A and H840A according to SEQ ID NO: 96 and dCas9 with mutations D10A, D839A, H840A and N863A according to SEQ ID NO: 97. However, in principle, all Cas enzymes of any known organism can be used within this method of the present invention.

In one embodiment of the method of trans-activating according to the present invention, the guideRNA comprises or consists of a nucleotide sequence as set forth in SEQ ID NOs: 76 to 88. In one further embodiment of the method of trans-activating, the at least one guideRNA is 2, 3, 4, 5, 6, 7, 8, 9, 10 or more guideRNAs.

In one embodiment of the method of trans-activating, the DNA-binding protein is C- or N-terminally fused to the at least one trans-activating domain of the transcriptional activator or transcription factor. In one embodiment of the method of trans-activating, the DNA-binding protein is N-terminally fused to the at least one trans-activating domain of the transcriptional activator or transcription factor. In one embodiment of the method of trans-activating, the DNA-binding protein is C-terminally fused to the at least one trans-activating domain of the transcriptional activator or transcription factor.

In one embodiment of the method of trans-activating according to the present invention, the at least one trans-activating domain of a transcriptional activator or transcription factor comprises or consists of VPR (SEQ ID NO: 89), preferably wherein the at least one trans-activating domain of the transcriptional activator are the trans-activating domains VP64 (SEQ ID NO: 73), p65 (SEQ ID NO: 74) and Rta (SEQ ID NO: 75), more preferably wherein the at least one trans-activating domain of the transcriptional activator comprises or consists of an amino acid sequence as set forth in SEQ ID NOs: 73, 74 and 75.

In one embodiment of the method of trans-activating according to the present invention, the nucleotide sequences of the native or genetically modified DNA-binding protein and of the at least one trans-activating domain of the transcriptional activator or transcription factor are on two separate plasmids and/or vectors.

In one embodiment of the method of trans-activating according to the present invention, the coding sequence of at least one gene of interest has a size of at least 0.5 kb, preferably at least 5 kb.

In one embodiment of the method of trans-activating according to the present invention, the method further comprises the use of recombinant AAV vectors of natural or engineered origin, preferably AAV vector variants with retinal cell type tropism and enhanced retinal transduction efficiency. Compared to the classical rAAV-mediated gene supplementation, the dCas9-VPR-mediated gene trans-activation approach would offer several important advantages. Trans-activation allows i) for activation of homologous genes irrespective of their size, which enables the development of treatments for diseases caused by mutations in very large genes (which violate the AAV genome size limit), ii) for close to physiological level of gene expression due to activation of an endogenous gene promoter, excluding excessively strong and potentially deleterious overexpression, which can in principle be caused by commonly used rAAV vectors equipped with strong promoters and intronless cDNA, iii) for efficient and simultaneous activation of multiple genes, which might be relevant for treatment of di- or polygenic diseases, and iv) development of more broadly applicable mutation-independent therapies (in contrast to the time-consuming and elaborative mutation-dependent gene editing approaches (individualized therapy)).

The method of trans-activating a homologous gene of at least one gene of interest and optionally deactivation of at least one gene of interest, wherein the mRNA encoded by the at least one gene of interest comprises a mutation compared to a control as described herein may be performed in vivo as well as in vitro in cell culture, preferably for therapeutic applications in vivo. Thus, in certain embodiments, the method relates to a method for treating a patient in need thereof comprising trans-activating a homologous gene of at least one gene of interest and optionally deactivation of at least one gene of interest (e.g., wherein the mRNA encoded by the at least one gene of interest comprises a mutation compared to a control); and wherein the method comprises the steps of:—binding of a complex comprising a native or genetically modified DNA-binding protein, at least one trans-activating domain of a transcriptional activator or transcription factor and at least one guideRNA, wherein the at least one guideRNA binds to the promoter region of the homologous gene of the at least one gene of interest or to other elements regulating the expression of the mRNA encoded by the homologous gene of the at least one gene of interest, optionally wherein a further guideRNA binds to the coding region, the promoter region and/or to other elements regulating the expression of the mRNA encoded by the at least one gene of interest; and, wherein the at least one gene of interest is selected from the group consisting of opsin genes, cyclic nucleotide-gated channel (CNG) genes, retinal-specific ATP-binding cassette transporter (ABC transporter) genes and myosin genes; —inducing the expression of the mRNA encoded by the homologous gene of the at least one gene of interest (and thereby trans-activating of the at least one gene of interest); and optionally deactivating the expression of the mRNA encoded by the at least one gene of interest. The patient in need thereof may be a patient with an inherited retinal dystrophy (IRD), preferably wherein the IRD is due to a mutation in at least one gene of interest selected from the group consisting of opsin genes, cyclic nucleotide-gated channel (CNG) genes, retinal-specific ATP-binding cassette transporter (ABC transporter) genes and myosin genes. The complex for use in the method of treatment may be specified as described herein in the context of the method of the invention.

The present invention further provides a complex comprising a native or genetically modified DNA-binding protein, at least one trans-activating domain of a transcriptional activator or transcription factor and at least one guideRNA for use in a method of treating an inherited retinal dystrophy (IRD) due to a mutation in at least one gene of interest selected from the group consisting of opsin genes, cyclic nucleotide-gated channel (CNG) genes, retinal-specific ATP-binding cassette transporter (ABC transporter) genes and myosin genes, comprising trans-activating a homologous gene of the at least one gene of interest and optionally deactivation of the at least one gene of interest (e.g., wherein the mRNA encoded by the at least one gene of interest comprises a mutation compared to a control), wherein the at least one guideRNA binds to the promoter region of the homologous gene of the at least one gene of interest or to other elements regulating the expression of the mRNA encoded by the homologous gene of the at least one gene of interest, optionally wherein a further guideRNA binds to the coding region, the promoter region and/or to other elements regulating the expression of the mRNA encoded by the at least one gene of interest; and, wherein the expression of the mRNA encoded by the homologous gene of the at least one gene of interest is induced; and optionally the expression of the mRNA encoded by the at least one gene of interest is deactivated. The complex for use may be specified as described herein in the context of the method of the invention.

Specifically, in certain embodiments, the native or genetically modified DNA-binding protein is selected from the group consisting of Cas-enzymes; preferably Cas9 (SEQ ID NO: 92), dCas9-enzymes (SEQ ID NO: 96, SEQ ID NO: 97), Cas12a (SEQ ID NO: 93) or Cas12b (SEQ ID NO: 94); zinc-finger nucleases; and transcription activator-like nucleases; and/or the at least one trans-activating domain of a transcriptional activator or transcription factor is selected from the group consisting of VPR (SEQ ID NO: 89), SAM (SEQ ID NO: 90), SunTag (SEQ ID NO: 91), VP64 (SEQ ID NO: 73), p65 (SEQ ID NO: 74), Rta (SEQ ID NO: 75) and combinations thereof. Preferably, the native or genetically modified DNA-binding protein and the at least one trans-activating domain of the transcriptional activator or transcription factor and the at least one guide RNA are provided as nucleotide sequences, more preferably the native or genetically modified DNA-binding protein and the at least one trans-activating domain of the transcriptional activator or transcription factor are separated in two split-fragments. In certain embodiments the nucleotide sequences of the native or genetically modified DNA-binding protein and of the at least one trans-activating domain of the transcriptional activator or transcription factor are on two separate plasmids and/or vectors. In certain embodiments the complex for use according to the invention comprises the use of recombinant AAV vectors. The AAV vectors may be of natural or engineered origin, preferably the AAV vectors are AAV vector variants with retinal cell type tropism and/or enhanced retinal transduction efficiency. Thus, in certain embodiments provided are nucleotide sequences of a native or genetically modified DNA-binding protein, at least one trans-activating domain of a transcriptional activator or transcription factor and at least one guide RNA for use in a method of treating an inherited retinal dystrophy (IRD) due to a mutation in at least one gene of interest selected from the group consisting of opsin genes, cyclic nucleotide-gated channel (CNG) genes, retinal-specific ATP-binding cassette transporter (ABC transporter) genes and myosin genes according to the invention. Preferably, the nucleotide sequences of the native or genetically modified DNA-binding protein and of the at least one trans-activating domain of the transcriptional activator or transcription factor are on two separate plasmids and/or vectors. In certain embodiments the two separate vectors are recombinant AAV vectors. The AAV vectors may be of natural or engineered origin, preferably AAV vector variants with retinal cell type tropism and/or enhanced retinal transduction efficiency.

The present invention further relates to an in vitro method of diagnosing a disease. Here, not a homologous gene is trans-activated, but a gene that may cause or may be associated with a disease. The utility of this approach becomes apparent in cases, where gene sequencing in theory would be possible, but could be replaced by a less expensive method such as PCR or Western Blot to look for mutations on mRNA or protein level—and not on genome level. This is especially useful when one has to analyze an mRNA or a protein that is expressed in cells that are not accessible in routine application, e.g. when samples from the retina or brain tissue are needed. By applying the approach described herein, mRNAs and/or proteins of genes that are expressed in cells or tissues, which can be hardly obtained from the patient, can be analyzed without the need of invasive removal of tissue samples, such as the retina or brain.

Accordingly, the present invention further relates to an in vitro method of diagnosing a disease, wherein the method comprises the steps of: a) Inducing the expression of the mRNA encoded by at least one gene of interest in a cell or tissue sample obtained from a subject; b) isolating the mRNA of step a); c) analyzing the sequence of the isolated mRNA of step b) and d) thereby detecting a mutation of the mRNA compared to a control, which is indicative for the presence of the disease. The term "mutation of the mRNA" as used herein encompasses in addition to mutations in the mRNA sequence (nucleotide deletions, insertions and/or substitutions) alterations of the mRNA, such as an altered splice pattern (also referred to as splice mutation), reduced mRNA stability and/or reduced expression (compared to control). Typically, the alteration of the mRNA is due to a mutation in the gene of interest, wherein the mutation can be in the coding region or the non-coding region, such as in the promoter, an activating region and/or an intron (e.g. generating, modifying or eliminating a splice donor site or a splice acceptor site). Preferably, the mutation is a mutation in the coding region or a splice mutation. In certain embodiments, the mutation and/or alteration result from a mutation causing the disease.

In one embodiment of the in vitro method of diagnosing a disease according to the present invention, the method further comprises inducing the expression of the protein encoded by the mRNA and analyzing the sequence, the expression level, the localization or the function of the at least one protein encoded by the mRNA in the cell or tissue sample.

In one embodiment of the in vitro method of diagnosing a disease according to the present invention, step a) comprises specific binding of a complex comprising a native or genetically modified DNA-binding protein and at least one trans-activating domain of a transcriptional activator or transcription factor to the promoter region of the at least one gene of interest or to other elements regulating the expression of the at least one gene of interest.

In one embodiment of the in vitro method of diagnosing a disease according to the present invention, the native or genetically modified DNA-binding protein is selected from the group consisting of Cas-enzymes; preferably Cas9 (SEQ ID NO: 92), dCas9-enzymes (SEQ ID NO: 96, SEQ ID NO: 97), Cas12a (SEQ ID NO: 93) or Cas12b (SEQ ID NO: 94); zinc-finger nucleases (ZFN); and transcription activator-like nucleases (TALENs). More preferably, the native DNA-binding protein is the Cas9 enzyme of *Streptococcus pyogenes* (SEQ ID NO: 92). More preferably, the genetically modified DNA-binding protein is selected from the group consisting of dCas9 with mutations D10A and H840A according to SEQ ID NO: 96 and dCas9 with mutations D10A, D839A, H840A and N863A according to SEQ ID NO: 97. However, in principle, all Cas enzymes of any known organism can be used within this method of the present invention.

In one embodiment of the in vitro method of diagnosing a disease according to the present invention, the native or genetically modified DNA-binding protein is a Cas-enzyme; preferably Cas9 (SEQ ID NO: 92), dCas9-enzymes (SEQ ID NO: 96, SEQ ID NO: 97), Cas12a (SEQ ID NO: 93) or Cas12b (SEQ ID NO: 94); and wherein the complex further comprises at least one guideRNA, which is able to bind to the promoter region of the at least one gene of interest or to other elements regulating the expression of the at least one gene of interest.

In one embodiment of the in vitro method of diagnosing a disease according to the present invention, the DNA-binding protein is C- or N-terminally fused to the at least one trans-activating domain of the transcriptional activator or transcription factor, preferably wherein the at least one trans-activating domain of a transcriptional activator or transcription factor is selected from the group consisting of VPR (SEQ ID NO: 89), SAM (SEQ ID NO: 90), SunTag (SEQ ID NO: 91), VP64 (SEQ ID NO: 73), p65 (SEQ ID NO: 74), Rta (SEQ ID NO: 75) and combinations thereof.

In one embodiment of the in vitro method of diagnosing a disease according to the present invention, the disease is a neurodegenerative disease, epilepsy, psychological diseases; preferably depression, mania, bipolar disorder, schizophrenia or autism; or a retinal disease, preferably an inherited retinal dystrophy, more preferably wherein the inherited retinal dystrophy is selected from the group consisting of age-related macular degeneration (AMD), genetically caused age-related macular degeneration (AMD), autosomal dominant, autosomal-recessive, X-linked or digenic retinitis pigmentosa, achromatopsia, Stargardt disease, Best disease, Leber's congenital amaurosis, retinoschisis, congenital stationary night blindness, choroideremia, early-onset retinal dystrophy, cone, rod-cone or cone-rod dystrophy, pattern dystrophies, Usher syndrome and other syndromic ciliopathies, even more preferably Bardet-Biedl syndrome, Joubert syndrome, Senior-Løken syndrome or Alström syndrome.

For carrying out the in vitro method of diagnosing a disease, the cells of the cell or tissue sample obtained from a subject can be transduced or transfected with the native or genetically modified DNA-binding protein, at least one trans-activating domain of a transcriptional activator or transcription factor and at least one guide RNA. Accordingly, in one embodiment, the method additionally comprises transfecting or transducing of the cell or tissue sample obtained from a subject.

The in vitro method of diagnosing a disease according to the present invention may be also used for analyzing the splice pattern of genes and/or proteins that are involved in the disease. Accordingly, the method of diagnosing a disease according to the present invention may further comprise detecting an altered splice pattern of the at least one gene of interest by analyzing the splice pattern of the at least one gene of interest for differences in comparison to a splice pattern of a control and wherein the altered splice pattern is also indicative for the presence of the disease. The term "splice pattern", as used within the context of the present invention, means a complete result of a splicing process. Intron splicing occurs in all eukaryotic organisms, but the splicing methods employed and the frequencies of splicing vary among each organism. Bacteria and archaea lack the spliceosomal pathway and splice infrequently via self-splicing introns. Among unicellular eukaryotes, there is a substantial range in splicing frequency. The number of introns and recognized splice sites may vary between individual mRNA transcripts of a single gene, giving rise to the phenomena of splice variation and alternative splicing. The latter then leads to different splice patterns.

In one embodiment of the in vitro method of diagnosing a disease according to the present invention, the cell sample from the subject is a blood sample, salivary sample, urinary sample, skin sample, or mucosa sample.

The invention is also directed to a nucleic acid sequence comprising or consisting of any of the sequences according to SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72 and SEQ ID NO: 123 for use in the treatment or prevention of a disease.

Further, the present invention is also directed to a nucleic acid sequence comprising or consisting of a nucleic acid sequence as set forth in SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72 and SEQ ID NO: 123 for use in any of the methods as described herein.

The present invention also comprises any of the nucleic acid sequences as described above for use in the treatment or prevention of a disease, wherein the disease is a neurodegenerative disease, epilepsy, psychological diseases; preferably depression, mania, bipolar disorder, schizophrenia or autism; or a retinal disease, preferably an inherited retinal dystrophy, more preferably wherein the inherited retinal dystrophy is selected from the group consisting of age-related macular degeneration (AMD), genetically caused age-related macular degeneration (AMD), autosomal dominant, autosomal-recessive, X-linked or digenic retinitis pigmentosa, achromatopsia, Stargardt disease, Best disease, Leber's congenital amaurosis, retinoschisis, congenital stationary night blindness, choroideremia, early-onset retinal dystrophy, cone, rod-cone or cone-rod dystrophy, pattern dystrophies, Usher syndrome and other syndromic ciliopathies, even more preferably Bardet-Biedl syndrome, Joubert syndrome, Senior-Løken syndrome or Alström syndrome.

Consequently, the approach of the present invention offers several important advantages: i) Due to its simplicity, it is suitable for routine diagnostics, ii) it can be used to detect novel nucleotide variants in known genes, iii) it can be used to re-classify known disease variants in pathogenic genes, iv) it can be used to validate (or challenge) the proposed pathogenicity of detected mutations, and v) it could be applied to any genetic disorders.

The disease may be, for example, a neurodegenerative disease, epilepsy, psychological diseases; preferably depression, mania, bipolar disorder, schizophrenia or autism; or a retinal disease, preferably an inherited retinal dystrophy, more preferably wherein the inherited retinal dystrophy is selected from the group consisting of age-related macular degeneration (AMD), genetically caused age-related macular degeneration (AMD), autosomal dominant, autosomal-recessive, X-linked or digenic retinitis pigmentosa, achromatopsia, Stargardt disease, Best disease, Leber's congenital amaurosis, retinoschisis, congenital stationary night blindness, choroideremia, early-onset retinal dystrophy, cone, rod-cone or cone-rod dystrophy, pattern dystrophies, Usher syndrome and other syndromic ciliopathies, even more preferably Bardet-Biedl syndrome, Joubert syndrome, Senior-Løken syndrome or Alström syndrome.

A variety of sequence based alignment methodologies, which are well known to those skilled in the art, can be used to determine identity among sequences. These include, but are not limited to, the local identity/homology algorithm of Smith, F. and Waterman, M. S. (1981) Adv. Appl. Math. 2: 482-89, homology alignment algorithm of Peason, W. R. and Lipman, D. J. (1988) Proc. Natl. Acad. Sci. USA 85: 2444-48, Basic Local Alignment Search Tool (BLAST) described by Altschul, S. F. et al. (1990) J. Mol. Biol. 215: 403-10, or the Best Fit program described by Devereau, J. et al. (1984) Nucleic Acids. Res. 12: 387-95, and the FastA and TFASTA alignment programs, preferably using default settings or by inspection. Alternatively, an alignment may be done manually/visually for amino acids sequences as follows: The percent identity between an amino acid sequence in question (query sequence) and an amino acid sequence of the invention/disclosed in the sequence listing (reference sequence), respectively, as defined herein is determined by pairwise alignment in such a way that the maximum identity is obtained between both amino acid sequences. The identical amino acid residues between both amino acid sequences are counted and divided by the total number of residues of the reference sequence (including positions that do not contain amino acid residues, e.g. one or more gaps) yielding the percentage of identity.

It is noted that as used herein, the singular forms "a", "an", and "the", include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. The term "at least one" refers, if not particularly defined differently, to one or more such as two, three, four, five, six, seven, eight, nine, ten or more. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "less than" or in turn "more than" does not include the concrete number.

For example, less than 20 means less than the number indicated. Similarly, "more than" or "greater than" means more than or greater than the indicated number, e.g. more than 80% means more than or greater than the indicated number of 80%.

Throughout this specification and the claims which follow, unless the context requires otherwise, the word "comprise", and variations such as "comprises" and "comprising", will be understood to imply the inclusion of a stated integer or step or group of integers or steps, but not the exclusion of any other integer or step or group of integer or step. When used herein the term "comprising" can be substituted with the term "containing" or "including" or sometimes when used herein with the term "having". When used herein "consisting of" excludes any element, step, or ingredient not specified.

The term "including" means "including but not limited to". "Including" and "including but not limited to" are used interchangeably.

The term "about" means plus or minus 10%, preferably plus or minus 5%, more preferably plus or minus 2%, most preferably plus or minus 1%.

Throughout the description and claims of this specification, the singular encompasses the plural unless the context otherwise requires. In particular, where the indefinite article is used, the specification is to be understood as contemplating plurality as well as singularity, unless the context requires otherwise.

It should be understood that this invention is not limited to the particular methodology, protocols, material, reagents, and substances, etc., described herein and as such can vary. The terminology used herein is for the purpose of describing particular embodiments only, and is not intended to limit the scope of the present invention, which is defined solely by the claims.

All publications cited throughout the text of this specification (including all patents, patent application, scientific publications, instructions, etc.), whether supra or infra, are hereby incorporated by reference in their entirety. Nothing herein is to be construed as an admission that the invention is not entitled to antedate such disclosure by virtue of prior invention. To the extent the material incorporated by reference contradicts or is inconsistent with this specification, the specification will supersede any such material.

The content of all documents and patent documents cited herein is incorporated by reference in their entirety.

A better understanding of the present invention and of its advantages will be gained from the following examples, offered for illustrative purposes only. The examples are not intended to limit the scope of the present invention in any way.

EXAMPLES OF THE INVENTION

The following examples illustrate the invention, but are not to be construed as limiting the scope of the invention.

Example 1: dCas9-VPR-Mediated Trans-Activation for Ocular Gene Therapy

Trans-activation of Cnga1 in 661w cells expressing the inducible full-length dCas9-VPR cassette Using dCas9-VPR in combination with three different gRNAs binding at the promoter region of mouse Cnga1 (SEQ ID NO: 13), we tested the trans-activation efficiency for this gene. For activation of Cnga1 (SEQ ID NO: 13), we used 661w cells, derivatives of an immortalized murine retinoblastoma expressing several cone-specific markers and lacking Cnga1 (SEQ ID NO: 13) expression (al-Ubaidi et al., 1992). In 661w cells stably expressing a doxycycline inducible dCas9-VPR cassette (SEQ ID NO: 123) in combination with Cnga1 gRNAs (target sequences of gRNAs in Cnga1 (SEQ ID NO: 76-SEQ ID NO: 78) including PAM sequences) we could detect Cnga1 signals on both, mRNA and protein level, which was completely absent in the 661w control cells stably expressing the dCas9-VPR lacZ gRNA cassette (SEQ ID NO: 124) (FIG. 3A-F). In addition, using patch clamp recordings, we could demonstrate that 661w cells carrying the dCas9-VPR Cnga1 gRNA cassette (SEQ ID NO: 123) show two key functional characteristics of Cnga1 specific currents: cGMP-dependent activation and $Ca^{2+}/Mg^{2+}$—dependent inhibition (FIG. 3G-L).

Example 2: Cas9 Split-Intein-Mediated Reconstitution Efficiencies

As mentioned above, the dCas9-VPR cassette (SEQ ID NO: 123) exceeds the packaging capacity of AAV vectors. To broaden the in vivo application spectrum of the dCas9-

Figure 4:
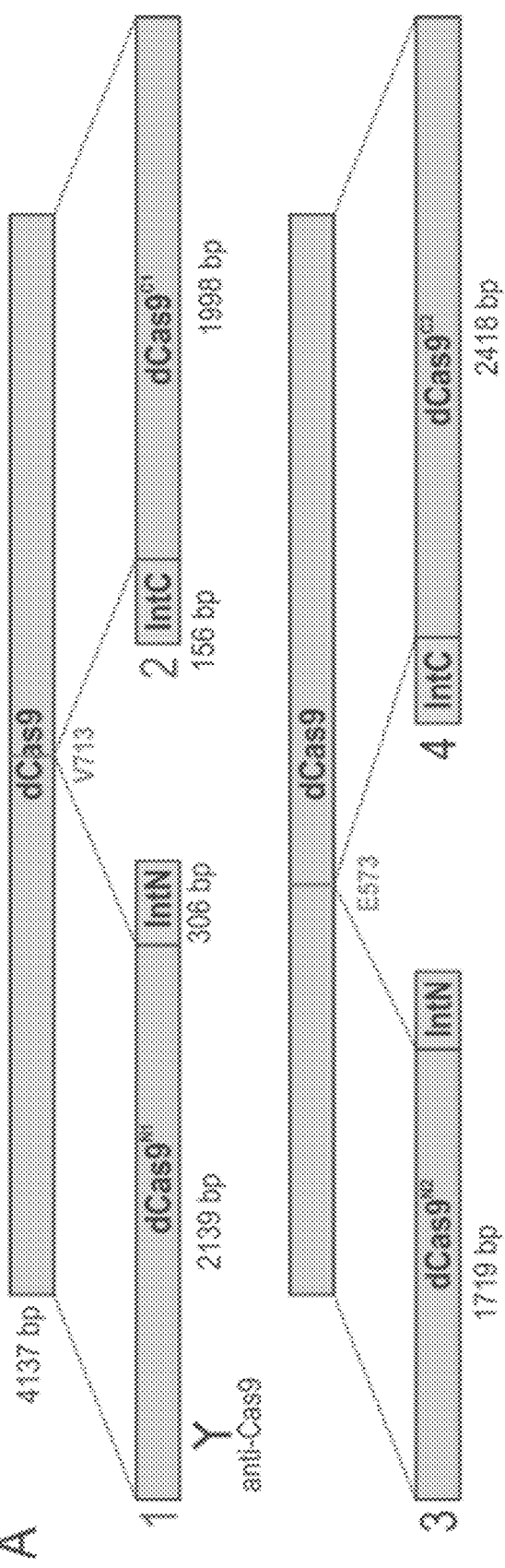
FIG. 4 shows the calculation of the split-intein efficiencies in HEK293 cells.
Figure 4:
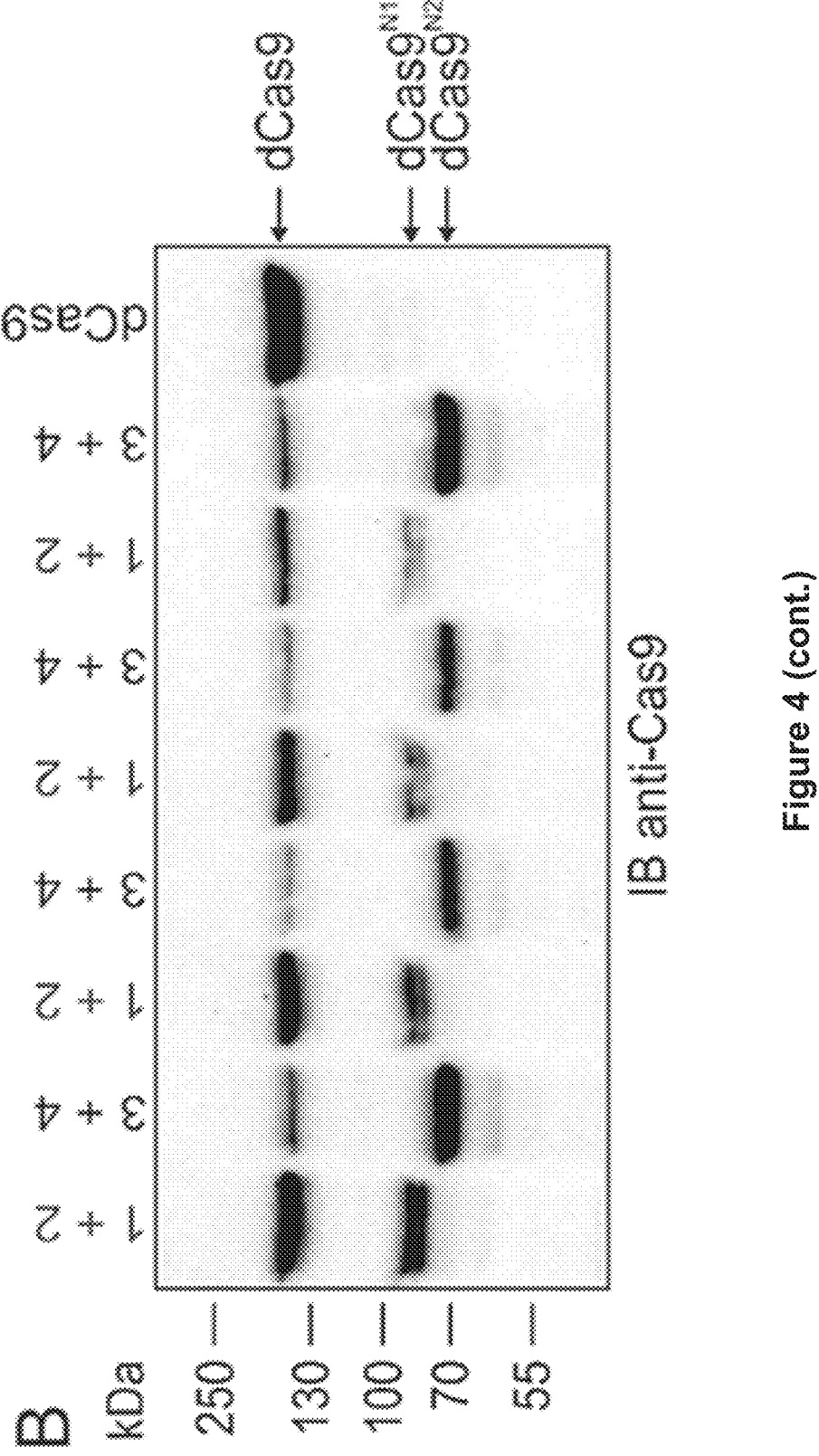

VPR system, we tested the efficiencies of the split-intein technology to reconstitute the dCas9-VPR split into two different parts and provided on two separate plasmids. The split-intein-mediated reconstitution efficiency is known to depend on the split position within the corresponding protein. In recent studies, two independent groups addressed the nuclease activity of Cas9 split either at the aa position E573 (Truong et al., 2015) or V713 (Chew et al., 2016) using the split-intein technology. Both groups have shown that nuclease activity of the split and reconstituted Cas9 in principle remained unchanged. However, no absolute or comparative data regarding the reconstitution efficiencies of Cas9 split at these two positions on protein level exist. In initial experiments in transiently transfected HEK293 cells, we quantified the reconstitution efficiency of the Cas9 split-intein fragments intersected at these two positions. As shown in FIG. 4, the reconstitution efficiency of the Cas9 variant split at V713 (56.9%±2.1%) was considerably higher than the one split at the E573 position (33.3%±2.1%).

Figure 5:
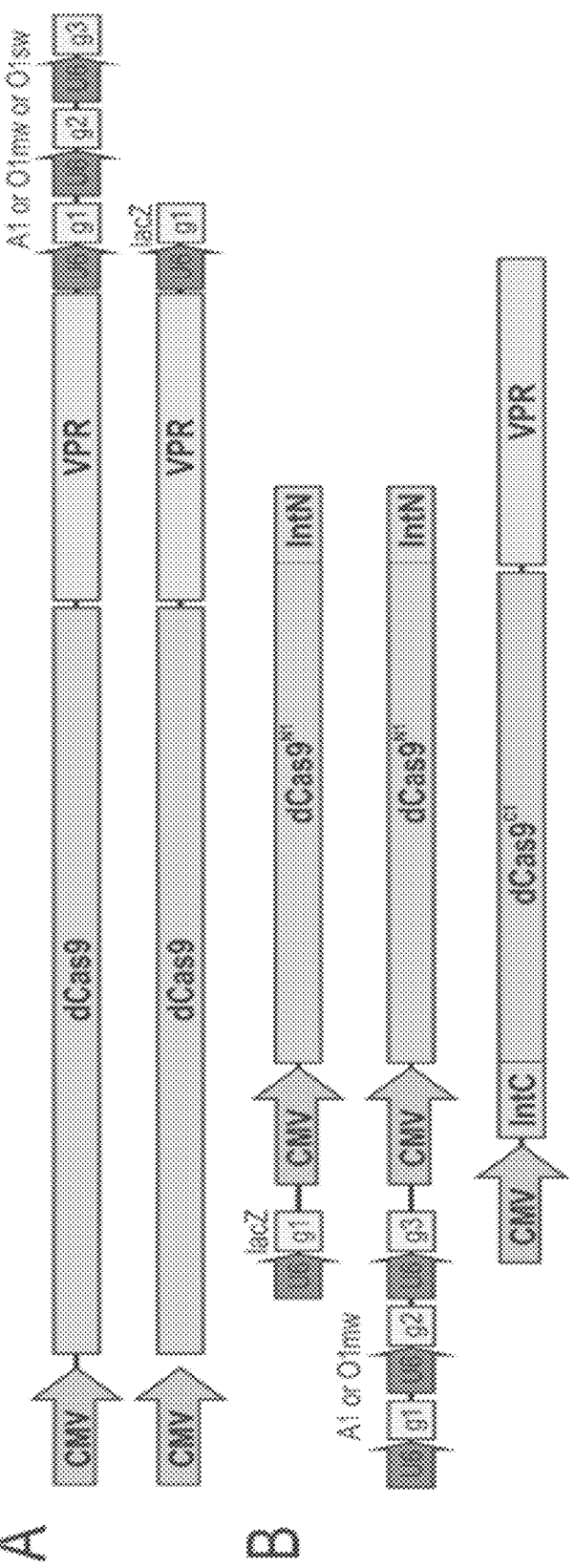
FIG. 5 shows dCas9-VPR (SEQ ID NO: 95) and split V713_dC9-mediated trans-activation of the Cnga1 (SEQ ID NO: 13), Opn1mw (SEQ ID NO: 43) and Opn1sw (SEQ ID NO: 45) genes in transiently transfected 661w or MEF cells.
Figure 5:
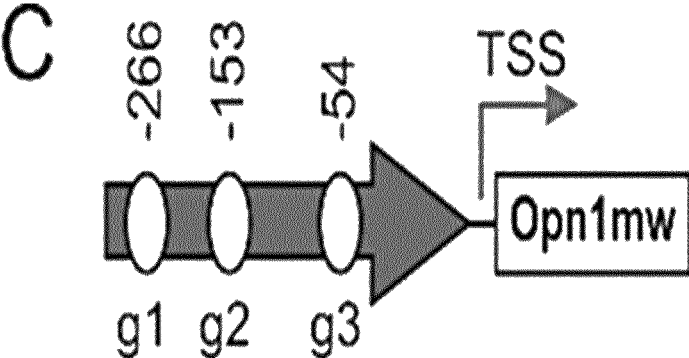
Figure 5:
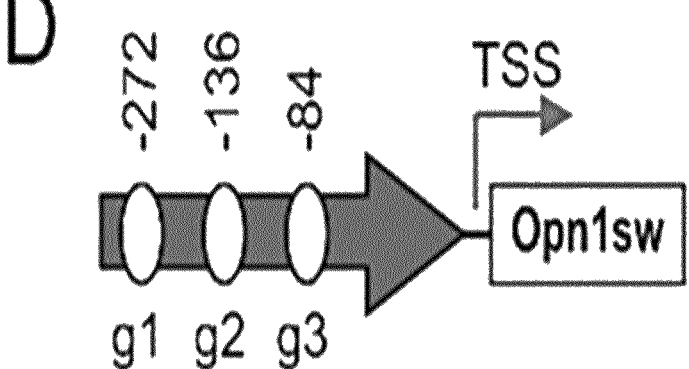
Figure 5:
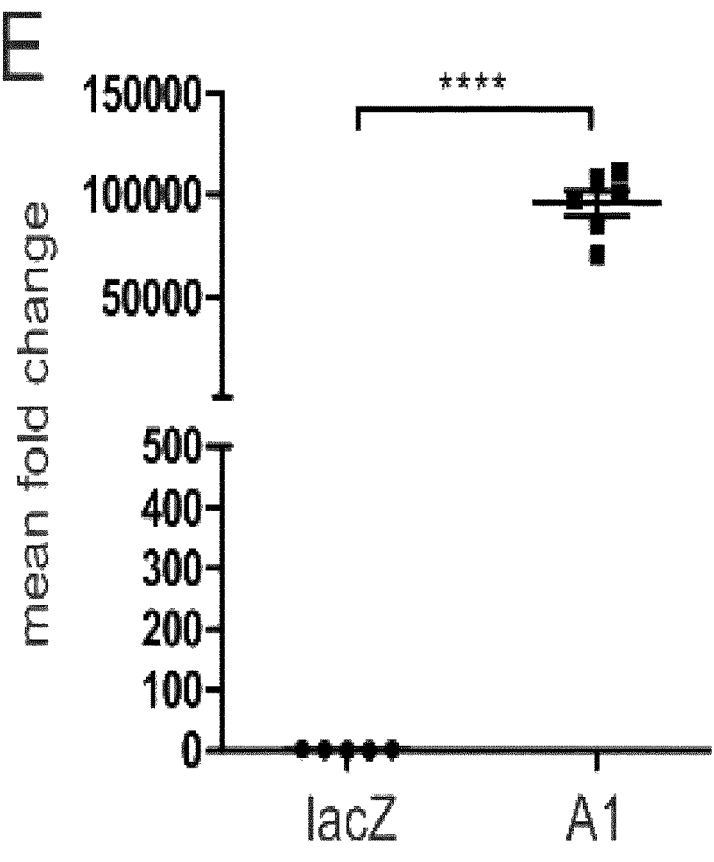
Figure 5:
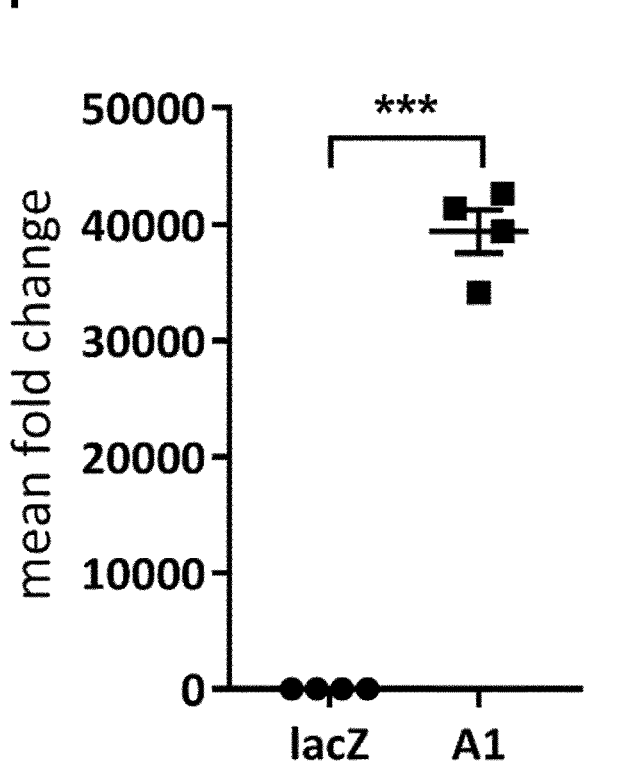
Figure 5:
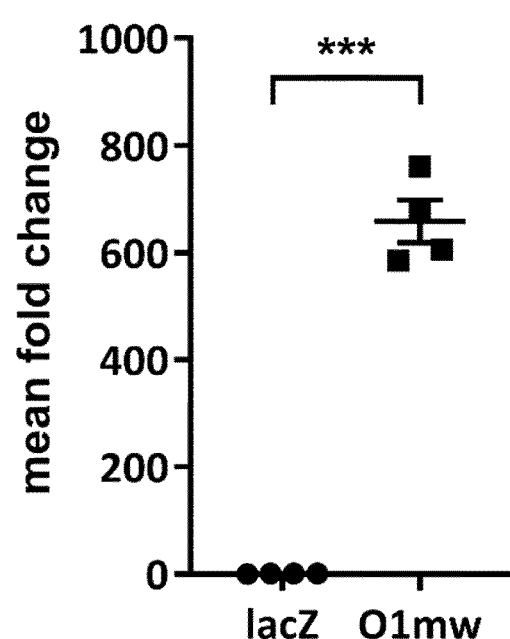
Figure 5:
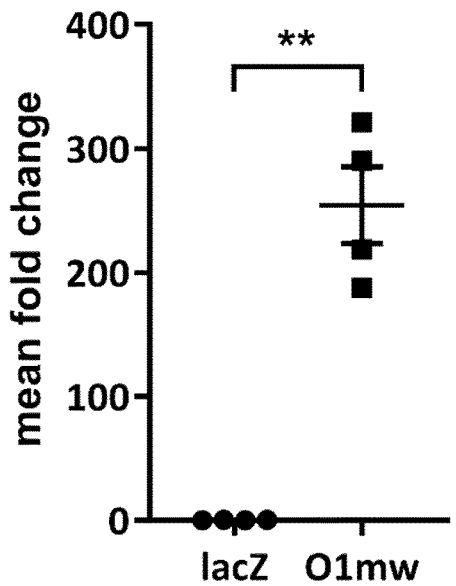
Figure 5:
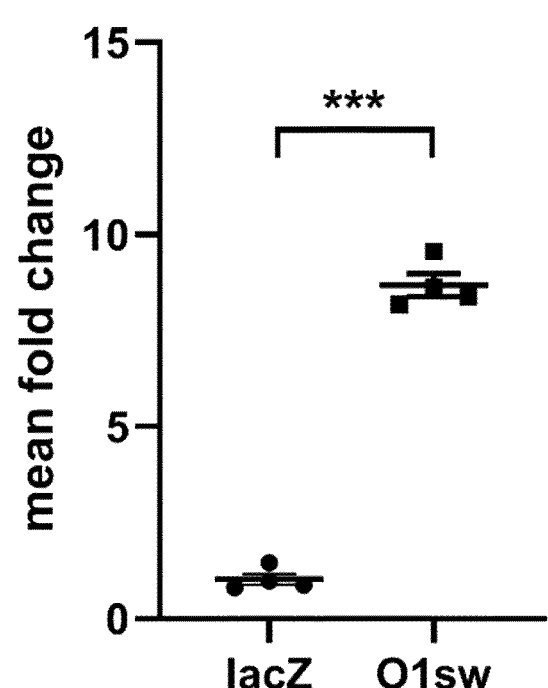

Example 3: dCas9-VPR and Split-Intein dCas9-VPR-Mediated Trans-Activation of Cngal (SEQ ID NO: 13), Opn1mw (SEQ ID NO: 43) and Opn1sw (SEQ ID NO: 45) Genes in Transiently Transfected 661w or MEF Cells The inventors also analyzed the trans-activation efficiencies of Cngal (SEQ ID NO: 13), Opn1mw (SEQ ID NO: 43) and Opn1sw (SEQ ID NO: 13) genes in cells transiently transfected with full-length dCas9-VPR (SEQ ID NO: 95) or with dCas9-VPR split at the V713 position (herein referred to as V713_dC9) in combination with respective gRNAs (FIG. 5). For trans-activation of cone opsins, we used mouse embryonic fibroblast (MEF) cells, which (in contrast to 661w cells) do not express considerable amounts of these genes. Using full-length dCas9-VPR (SEQ ID NO: 95), the inventors observed efficient trans-activation of all three genes. Similarly, V713_dC9 in combination with Cngal (target sequences of gRNAs in Cngal including PAM sequence: SEQ ID NOs: 76-78) or Opn1mw (target sequences of gRNAs including PAM sequence: SEQ ID NOs: 79-81) gRNAs could also trans-activate both genes, albeit with lower efficiencies when compared to the full-length dCas9 variant. So far, the inventors did not include the V713_dC9 in combination with Opn1sw gRNAs (target sequences of gRNAs including PAM sequence: SEQ ID NOs: 83-85) in this in vitro setting. In all cases, no trans-activation of the respective genes was detectable in cells expressing the lacZ control gRNA (target sequence of gRNA in lacZ including PAM sequence: SEQ ID NO: 125).

Example 4: V713_dC9-Mediated Trans-Activation of Opn1mw (SEQ ID NO: 43) and Opn1sw (SEQ ID NO: 45) in Rod Photoreceptors The inventors also analyzed whether V713_dC9 can trans-activate Opn1mw (SEQ ID NO: 43) and Opn1sw (SEQ ID NO: 45) genes in rod photoreceptors of wild type mice. For this purpose, the inventors injected the mice with an AAV2/8 virus serotype equipped with a human rhodopsin promoter (FIG. 6A) for specific expression in rods. Three weeks post injection, retinas of injected animals were used for immunolabeling or for RNA isolation followed by qRT-PCR studies.

When compared to cones, rod photoreceptors are present at much higher density in all parts of the murine retina. In addition, the outer segments of murine rods are longer than those originating from cones. These properties enable to easily distinguish between rod and cone photoreceptor outer segments. The inventors could detect a robust increase in signals for Opn1mw (SEQ ID NO: 44) and Opn1sw (SEQ ID NO: 46) in >50% of injected retinas immune-labeled with the specific antibodies. This signal was spread throughout the photoreceptor outer segments around the injection site and was characteristic for rod outer segment specific proteins. Therefore, the inventors concluded that the increased Opn1mw (SEQ ID NO: 44) and Opn1sw (SEQ ID NO: 46) signal was very likely originating from the V713_dC9-mediated trans-activation of the corresponding genes (FIG. 6B-E).

Figure 6:
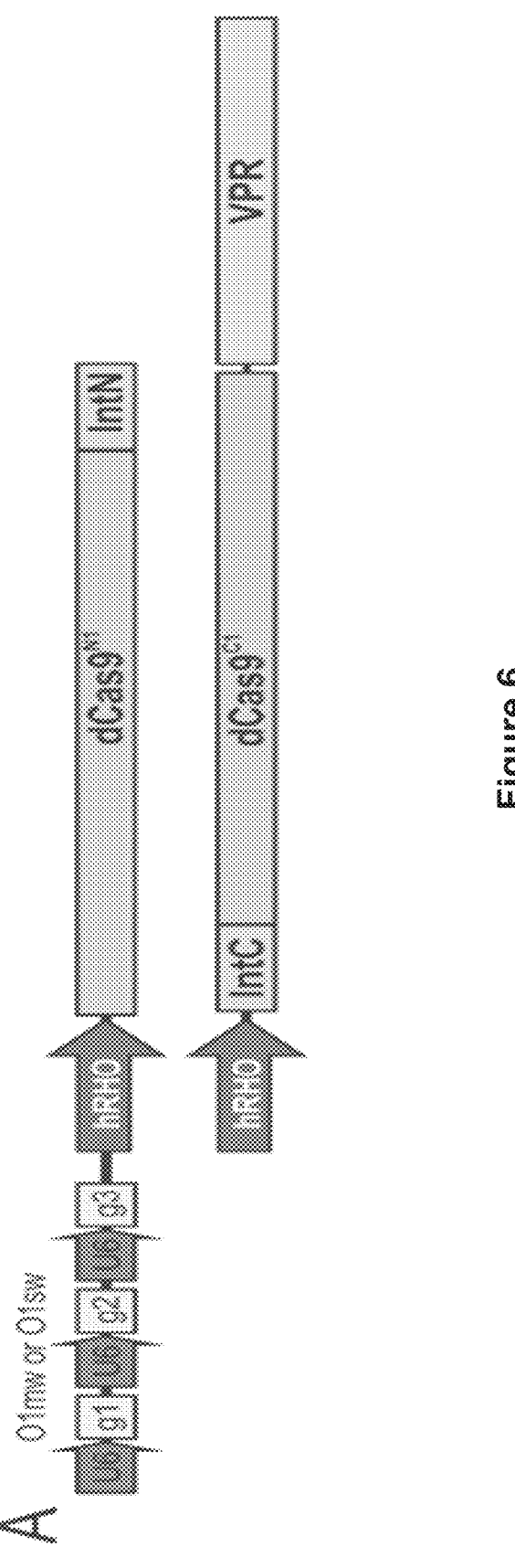
FIG. 6 shows in vivo trans-activation of Opn1mw (SEQ ID NO: 43) and Opn1sw (SEQ ID NO: 45) using V713_dC9.
Figure 6:
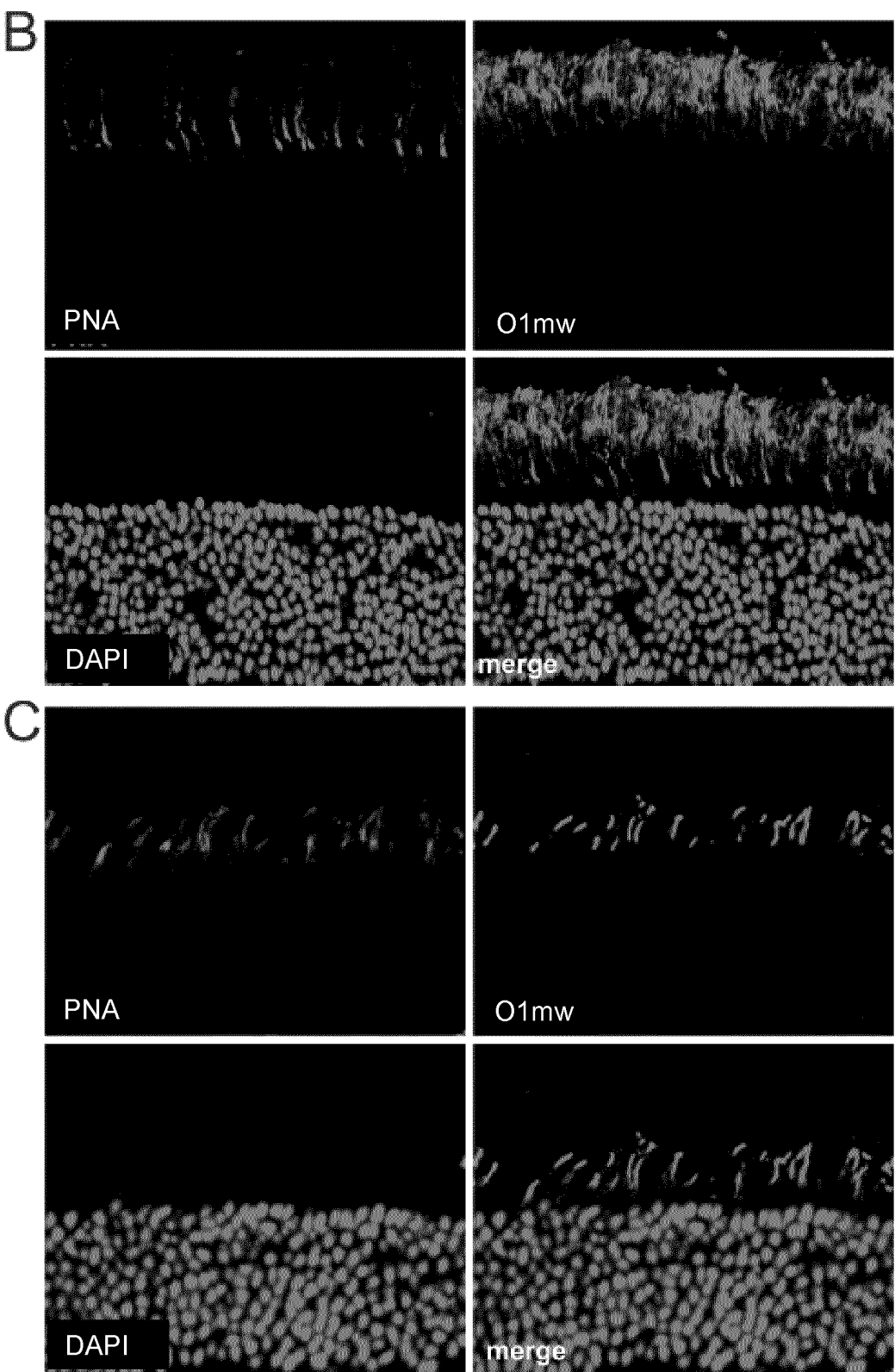
Figure 6:
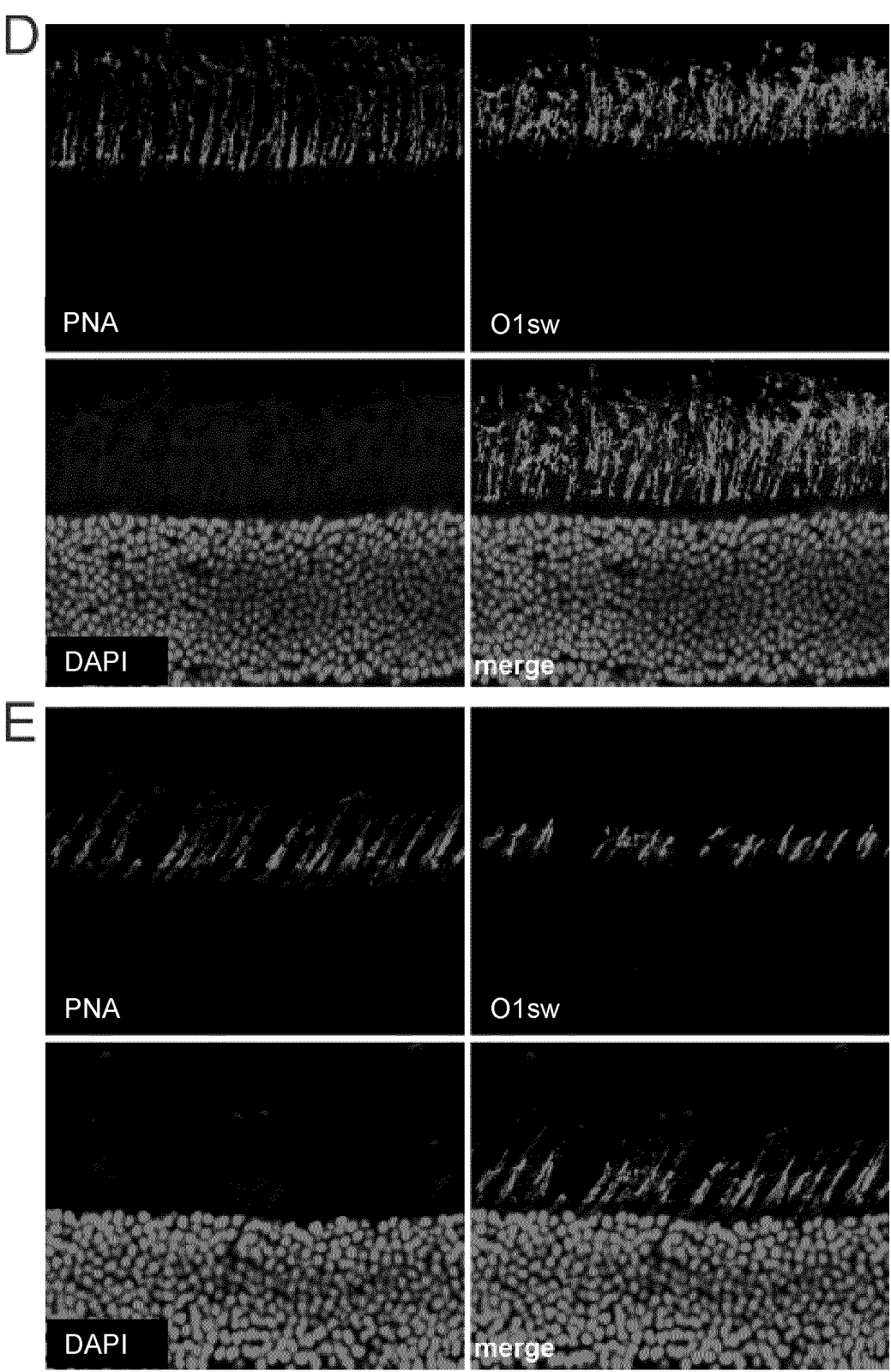
Figure 6:
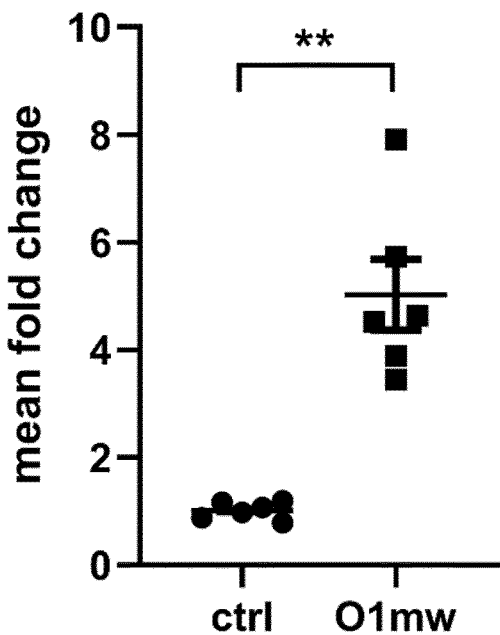
Figure 6:
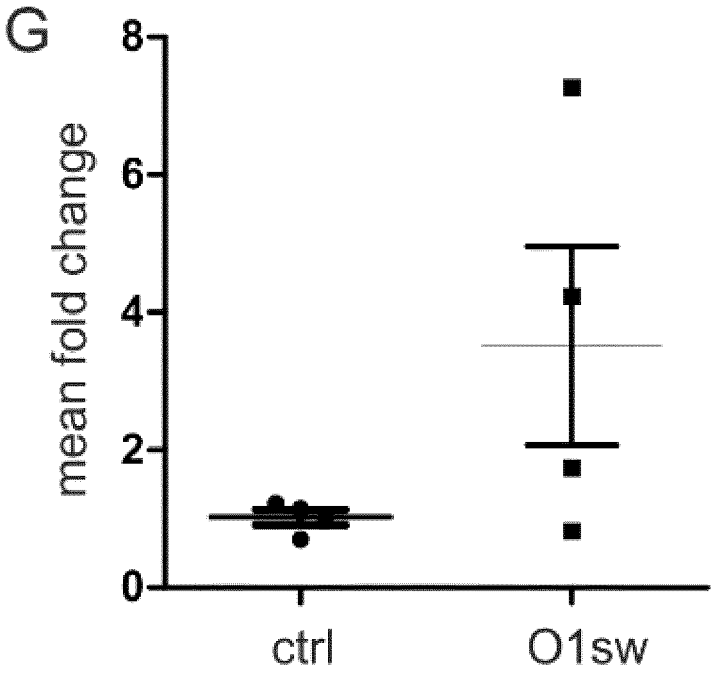

In the corresponding qRT-PCR experiments, 50% (Opn1sw. FIG. 6G) to 100% (Opn1mw, FIG. 6F) of the injected retinas showed an increase in Opn1mw (SEQ ID NO: 43) and Opn1sw (SEQ ID NO: 45) mRNA levels. This increase was lower when compared to the corresponding experiments in MEF cells shown in FIG. 5G. Nevertheless, this finding is rather expectable, as (in contrast to MEF cells) both genes are endogenously highly expressed in the cones of the injected mice.

Figure 7:
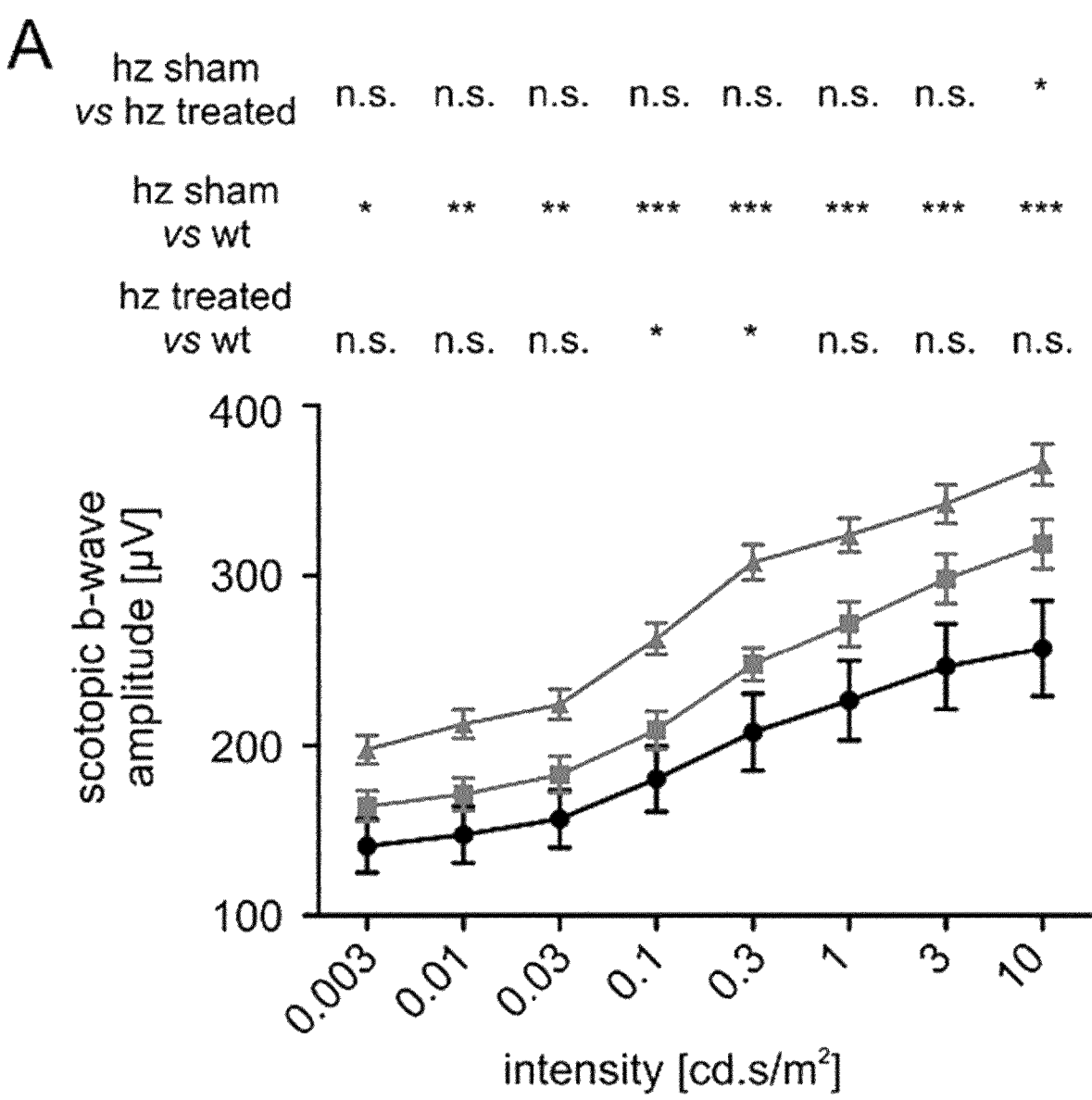
FIG. 7 shows that M-opsin activation improves the retinal phenotype in heterozygous Rho mice. Heterozygous (hz) Rho mice (n=10) were injected at P14 and electroretinography (ERG, A) and optical coherence tomography (OCT, B) were performed 12 months post injection. One eye was injected with dCas9-VPR (SEQ ID NO: 95) (hz treated) and the contralateral eye was sham injected with NaCl (hz sham). Both eyes (OD, oculus dexter and OS, oculus sinister) from ten untreated wild type (wt) mice (12 months) served as controls.
Figure 7:
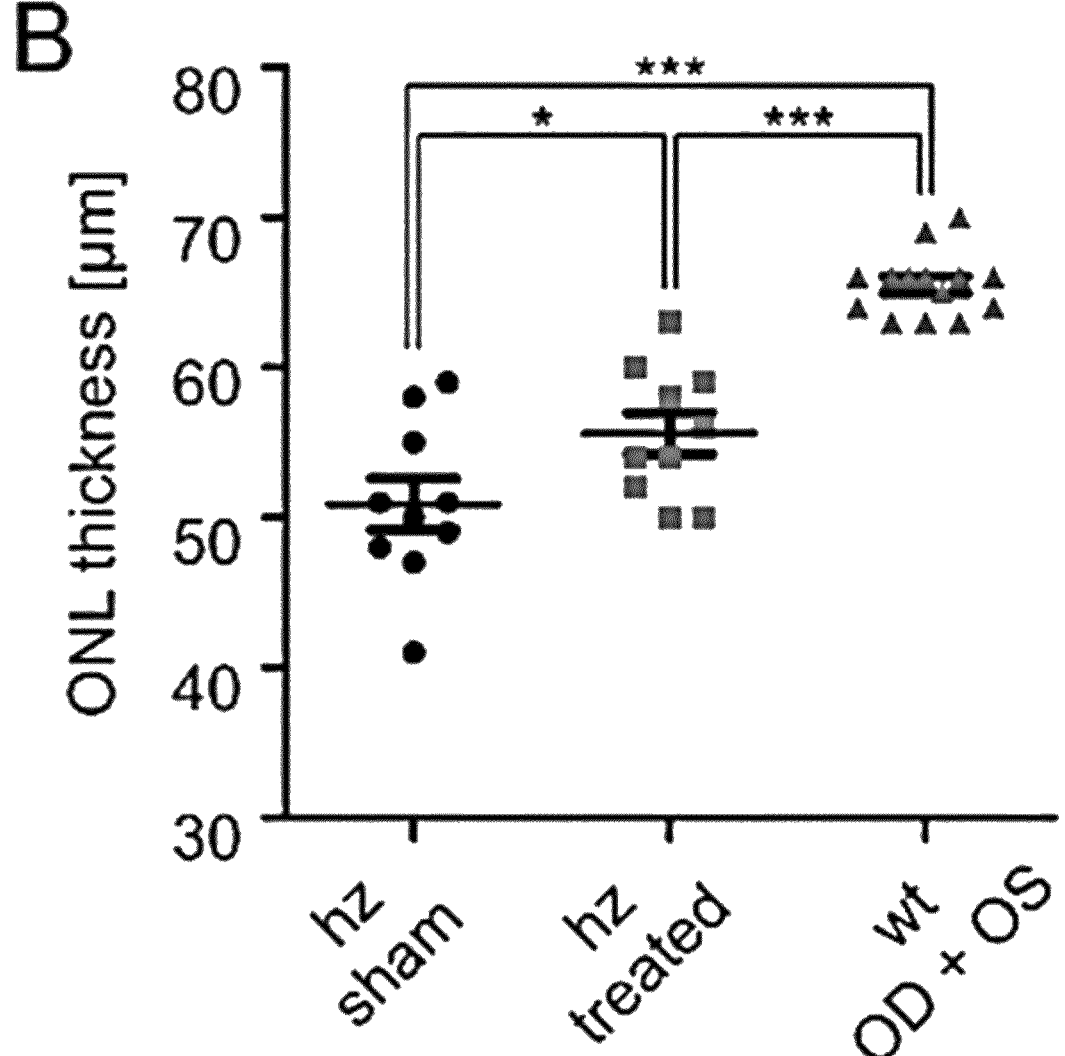

Example 5: Opn1mw Transactivation Delays Retinal Degeneration and Improves Retinal Function in Heterozygous Rho Mice The inventors also tested whether Opn1mw transactivation is sufficient to ameliorate the retinitis pigmentosa phenotype in a heterozygous rhodopsin-deficient RP mouse model (Humphries et al., 1997). For this purpose, heterozygous (hz) Rho mice were subretinally injected with titer-matched dual rAAV vectors expressing the split dCas9-VPR and Opn1mw sgRNAs (hz treated). The contralateral control eye was injected with a NaCl (hz sham) solution (FIG. 7).

As heterozygous Rho mice show a slow course of retinal degeneration (Humphries et al., 1997), the effects of the treatment were assessed one year after injection and age-matched untreated WT mice served as an additional control. Retinal degeneration is accompanied by a reduction of photoreceptors, a condition that can be addressed non-invasively by optical coherence tomography (OCT) measuring the thickness of the outer nuclear layer (ONL). OCT recordings from eyes expressing split dCas9-VPR and Opn1mw sgRNAs revealed an increase in the ONL thickness compared to the contralateral NaCl-injected eye, suggesting that the treatment is capable of delaying the degeneration (FIG. 7B).

To assess beneficial effects of the approach on rod-mediated (scotopic) retinal function, the inventors performed electroretinography (ERG) measurements in dark-adapted heterozygous Rho mice (FIG. 7A). A pronounced improvement of the scotopic b-wave was observed when comparing the treated eyes to their NaCl-injected counterparts. Conclusively, these data suggest that Opn1mw trans-activation can ameliorate retinal degeneration and results in improved retinal function in the heterozygous Rho RP mouse model.

Example 6: dCas9-VPR-Mediated Trans-Activation for Diagnostics of Genetic Disorders To provide a proof-of-principle of CRISPR/Cas9-mediated trans-activation for a frequent IRD-linked gene, we focused on USH2A (SEQ ID NO: 49) for several reasons. First, USH2A (SEQ ID NO: 49) is the most common autosomal recessive retinitis pigmentosa (arRP) and Usher Syndrome (USH) gene (accounting for 10-15% of arRP and 30-40% of USH cases, (Huang et al., 2018)). Second, the collaborating LMU Eye Hospital in Munich harbors a large USH2A (SEQ ID NO: 49) patient cohort. In some of these patients only one USH2A (SEQ ID NO: 49) mutation could be identified, suggesting the presence of the second variant in regions, which were not covered by the routine genetic diagnostic. Third, USH2A (SEQ ID NO: 49) is not expressed in tissues and/or cell types, which can be routinely obtained from the patients (https://www.proteinatlas.org/ ENSG00000042781-USH2A/tissue), impeding the USH2A (SEQ ID NO: 49) mRNA analysis in naïve patients' cells. Fourth, USH2A (SEQ ID NO: 49) belongs to the largest genes in the human genome, hampering the identification of potentially pathogenic mutations, especially those located in non-coding regions.

For experiments addressing the trans-activation of USH2A (SEQ ID NO: 49), human fibroblasts were isolated from the skin biopsy of one of the inventors. The cells were cultivated according to the standard procedures described previously (Chen et al., 2014) and transiently transfected with dCas9-VPR (SEQ ID NO: 95) in combination with three different USH2A gRNAs (target sequences of gRNAs in USH2A including PAM sequence: SEQ ID NOs: 86-88) targeting the native USH2A promoter in human fibroblasts. dCas9 (SEQ ID NO: 96) in combination with the lacZ specific gRNA (target sequence of gRNA in lacZ including PAM sequence: SEQ ID NO: 125) was used as control.

Figure 8:
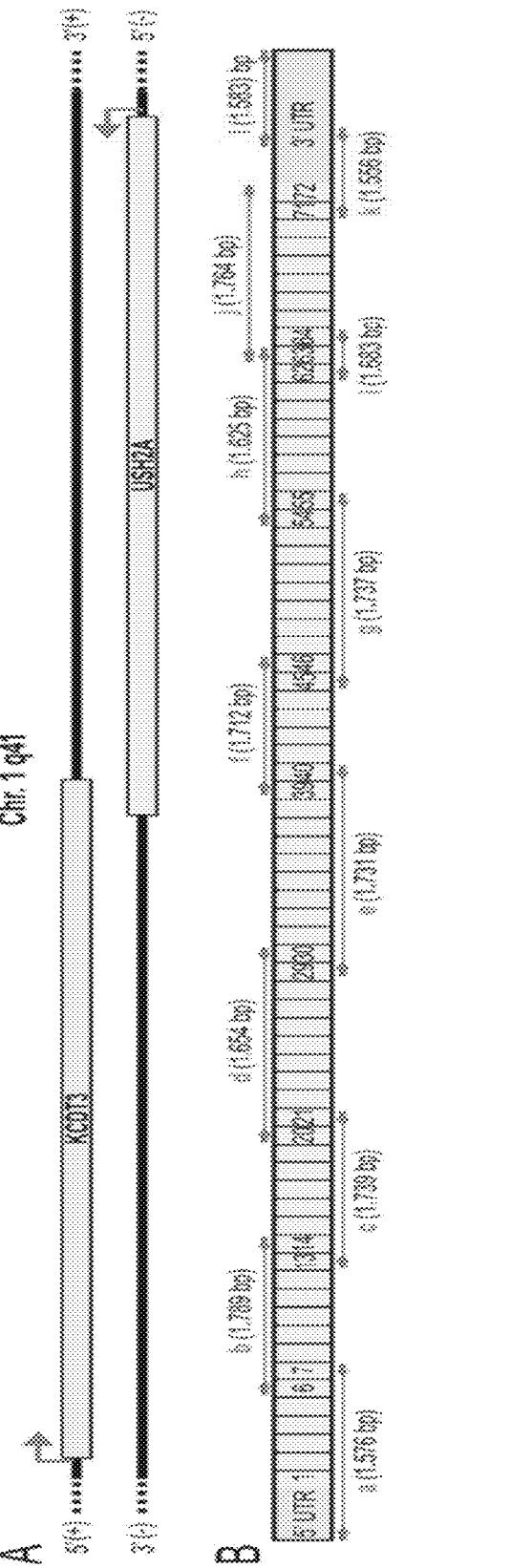
FIG. 8 shows dCas9-VPR-mediated trans-activation of USH2A (SEQ ID NO: 49) in human fibroblasts.
Figure 8:
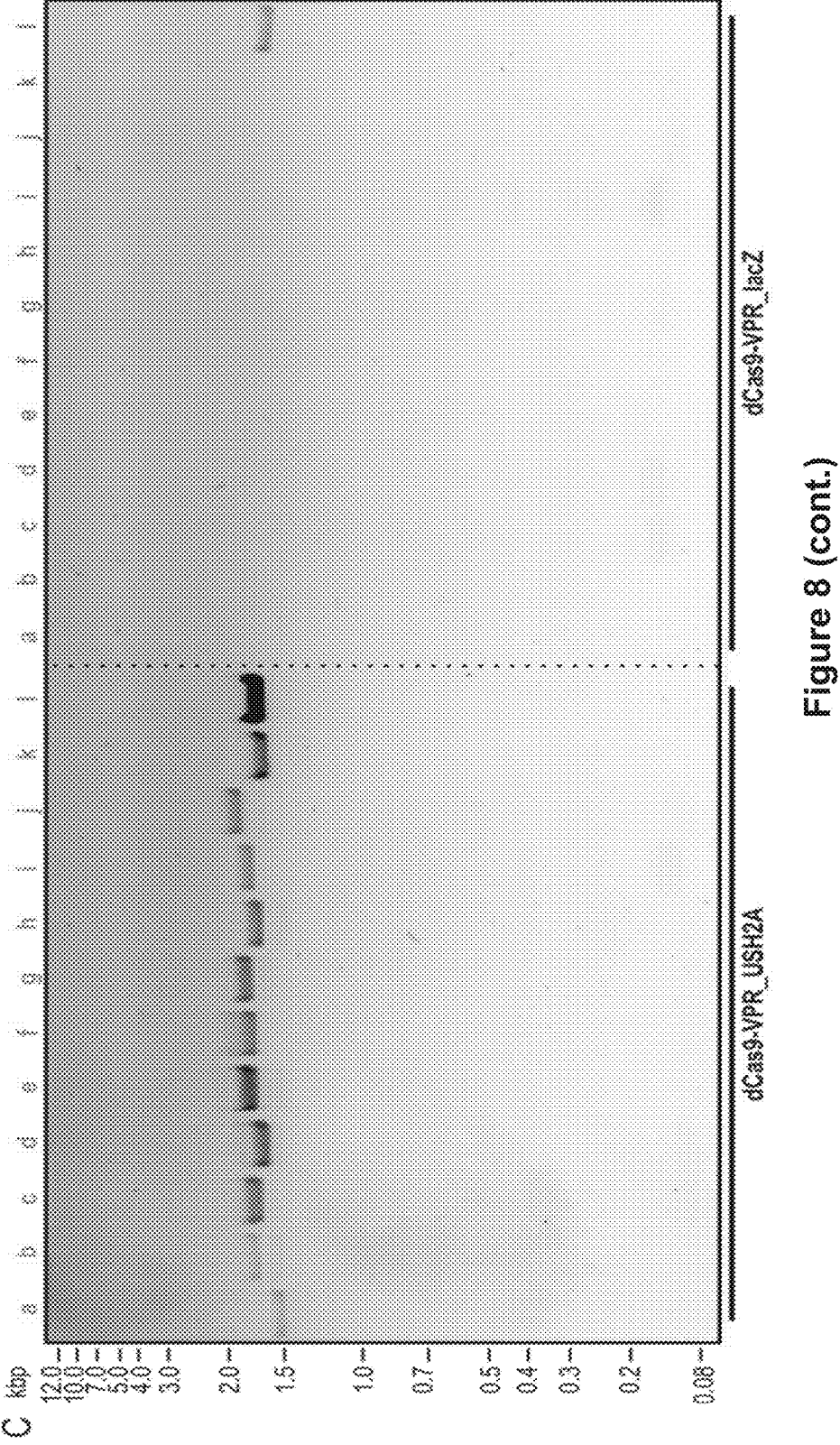
Figure 8:
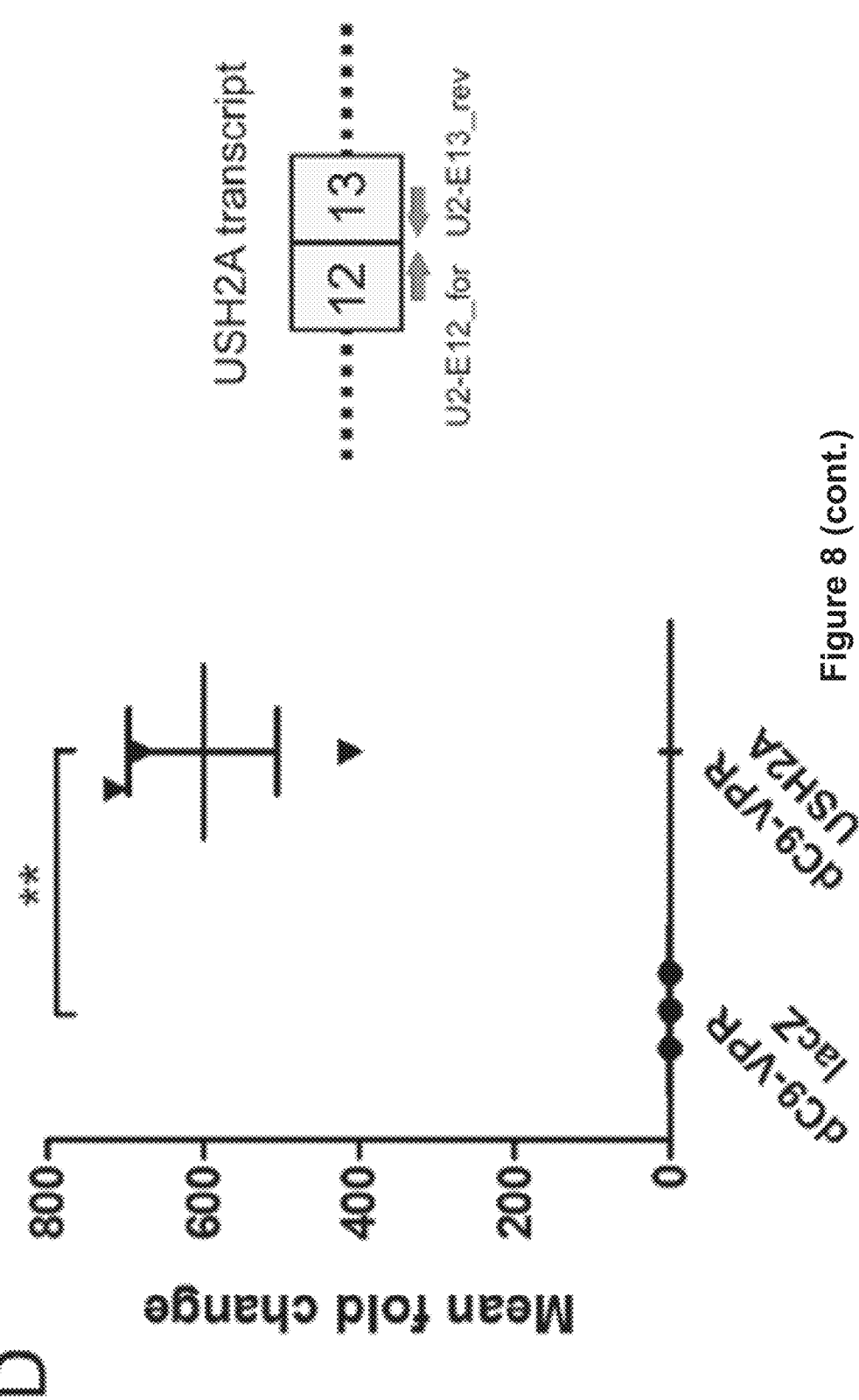
Figure 9:
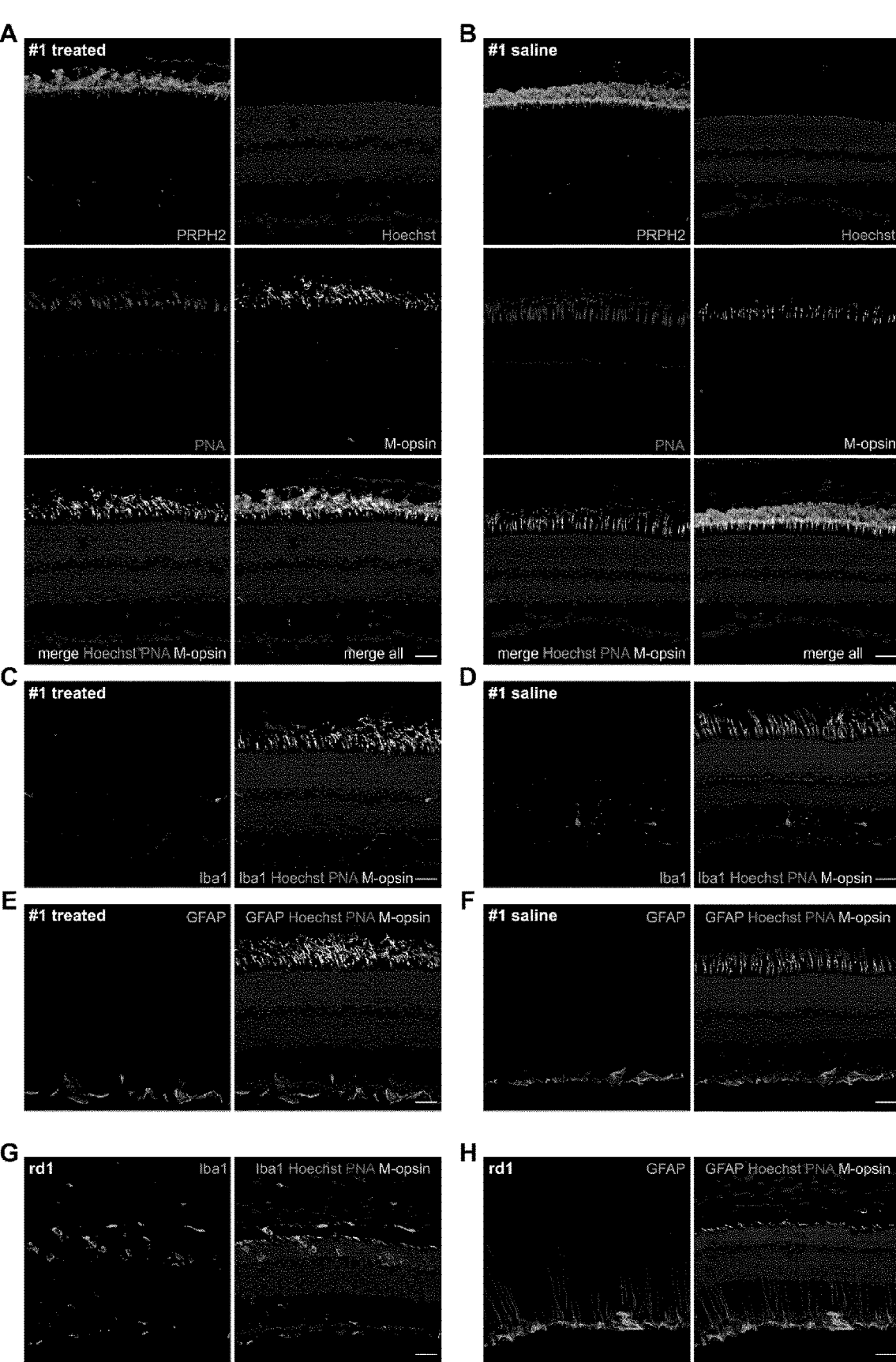
FIG. 9 shows that transactivation of Opn1mw in heterozygous Rho mice does not evoke any microglial activation or reactive gliosis. A, B Representative immunostainings of retinas from the heterozygous Rho mouse #1 injected with either V713_dC9 and Opn1mw (M-Opsin)-specific gRNAs (A, treated) or saline (B, sham, contralateral eye). A peripherin-2 antibody (PRPH2) was used as rod and cone outer segment marker and peanut agglutinin (PNA) as a marker for cones. C-F Immunolabeling of the same retinas with Iba1 or GFAP to visualize microglial cells or reactive gliosis in the treated (C, E) and saline-injected contralateral eye (D, F). G, H Immunolabeling of retinas from Pde6b-deficient (rd1) mice on P13 with Iba1 (G) or GFAP (H) served as a positive control. Scale bar 30 μm.

USH2A (SEQ ID NO: 49) is situated on the (–)—strand of chromosome 1 q41. Another gene (KCTD3) (SEQ ID NO: 122) is located in close proximity to USH2A (SEQ ID NO: 49) on the opposite (+)—strand and both genes have an overlap in the distal part of the 3' untranslated region (UTR) (FIG. 8A). USH2A (SEQ ID NO: 49) trans-activation was analyzed on RT-PCR and qRT-PCR level using USH2A specific primers (see SEQ ID NOs: 98-121; FIGS. 8B-D). For RT-PCR experiments, we designed a set of 12 primer pairs (SEQ ID NOs: 98-121) covering the entire USH2A (SEQ ID NO: 49) transcript. The size of the individual PCR-products ranges between 1.5-1.8 kb, enabling for a convenient analysis on mRNA level and for detection of potential splice mutations from patients' cells. In cells transfected with the dCas9-VPR (SEQ ID NO: 95) in combination with USH2A gRNAs (target sequences of gRNAs in USH2A including PAM sequence: SEQ ID NOs: 86-88), all primer pairs (SEQ ID NOs: 98-121) led to specific bands at the expected size. The identity of each band was confirmed by Sanger sequencing. Excepting for the last primer pair covering the distal 3'UTR region, no bands were detected in fibroblasts transfected with the lacZ control gRNA (target sequence of gRNAs in lacZ including PAM sequence: SEQ ID NO: 125). As expected, Sanger sequencing of the 3'UTR band in the lacZ control cells confirmed that it originates from the KCDT3 gene (SEQ ID NO: 122), which overlaps with USH2A (SEQ ID NO: 49) in the distal 3'UTR.

Figure 10:
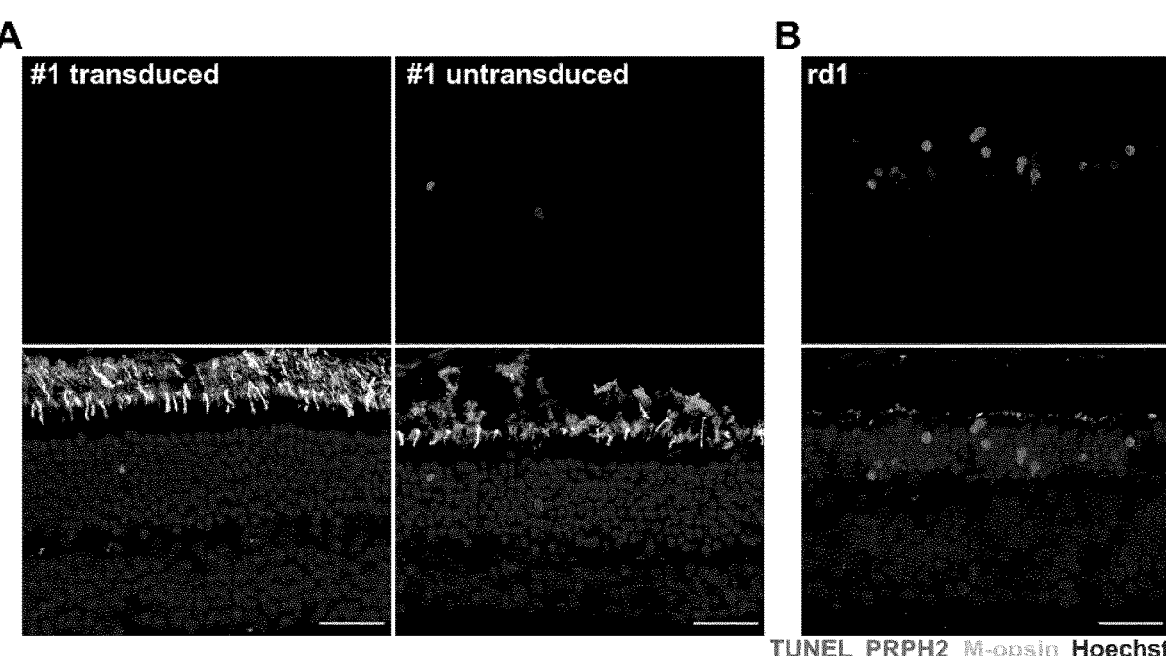
FIG. 10 shows that transactivation of Opn1mw in heterozygous Rho mice reduces apoptosis. A Representative sections of the immunolabeled retina from the heterozygous Rho mouse #1 injected with V713_dC9 and Opn1mw (M-Opsin)-specific gRNAs showing a transduced (left panel) or untransduced (right panel) area of the same retina one year post-injection. B Immunolabeling of the rd1 mouse retina on P13 served as a positive control. TUNEL staining (upper panel) was used to visualize apoptosis, PRPH2 was used as rod and cone outer segment marker (lower panel). Scale bar 30 μm. C Quantification of TUNEL+ cells in transduced vs. untransduced areas of retinas from eight heterozygous Rho mice (+/−) injected with V713_dC9 and Opn1mw-specific sgRNAs. A paired t-test (two-tailed) was used for statistical analysis.
Figure 10:
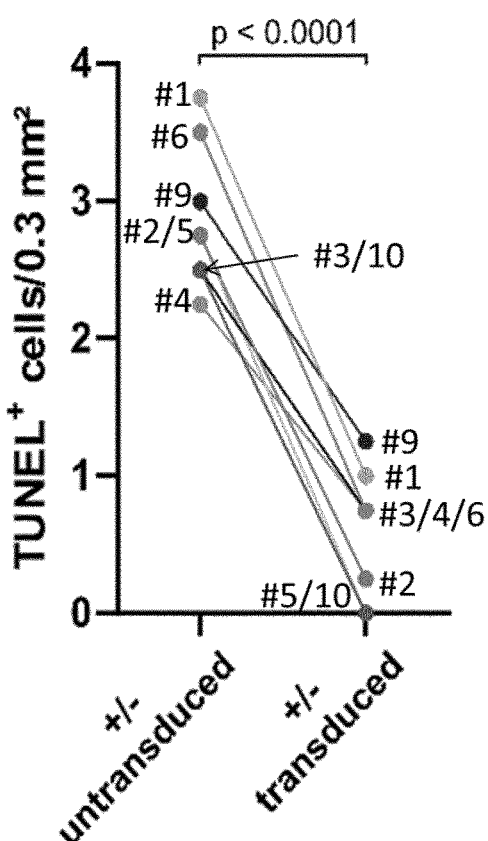

Example 7: Opn1mw Transactivation Reduces Apoptosis without Inducing Gliosis or Invasion of Immune Responsive Cells in Heterozygous Rho Mice To assess the translational potential of this approach, we examined whether our treatment induced persistent gliosis or immune responses, which would be accompanied by proliferation of glial fibrillary acidic protein (GFAP)—positive Müller glia or ionized calcium binding adaptor molecule 1 (Iba-1)—positive microglial or mononuclear cells in the retina. Importantly, immune labeling of the retinas with these markers revealed no obvious increase in the number of glial, microglial or mononuclear cells between the different groups in contrast to retinas of rd1 (retinal degeneration 1) mice exhibiting a fast retinal degeneration peaking on P13 (J. Sancho-Pelluz et al., *Mol Neurobiol* 38, 253-269 (2008)) (FIG. 9C-H). To investigate whether photoreceptor degeneration is caused by apoptosis in the heterozygous Rho mouse model, we conducted a TUNEL assay on retinal sections from the treated heterozygous Rho mice (FIG. 10A, B). To detect apoptosis, the terminal deoxynucleotidyltransferase-mediated dUTP-biotin nick end labeling (TUNEL) assay was performed using the In Situ Cell Death Detection Kit, Fluorescein (11684795910; Roche) according to the manufacturer's instruction. In this assay, we could detect a low, but considerable number of TUNEL-positive cells indicating that apoptosis is the underlying mechanism for the photoreceptor loss in this mouse model. Moreover, by comparing the number of TUNEL positive cells per area in the transduced vs. untransduced part of the treated retinas we show that Opn1mw transactivation reduces apoptosis (FIG. 100). These data further emphasize the beneficial effects of our treatment on photoreceptor survival.

Example 8: gRNA Multiplexing Approach for Simultaneous Rho Knockdown and Opn1mw Activation dCas9-VPR-mediated trans-activation of homologous genes enables the treatment of disease-causing loss-of-function mutations, in which the lacking protein encoded by the gene of interest is driving the disease. However, many genetic diseases are caused by gain-of-function or dominant negative mutations resulting in the production of harmful protein from the gene of interest. Successful treatment of such a mutation would require not only a compensation for the missing functional protein, but a simultaneous removal of the mutated harmful protein. To test the applicability of the above-mentioned method for such a purpose, the inventors used a catalytically active Cas9-VPR in combination with a gRNA comprising a protospacer (PS)>16 bp, which retains the Cas9 catalytic activity, to knock down the murine rhodopsin gene (Rho) (target sequence of sgRho including PAM sequence: SEQ ID NO: 82). Moreover, they employed two or more gRNAs with a short protospacer sequence (<16 bp), which suppress the catalytic activity of the Cas9 protein, targeting the promoter of the murine M-Opsin gene (Opn1mw) (target sequence of sgOpn1mw_1_short: ggggcctttaaggtaagg, SEQ ID NO: 126 (including PAM sequence) and sgOpn1mw_2_short: gccacccctgtggattgg, SEQ ID NO: 127 (including PAM sequence)) to activate this rhodopsin homolog (FIG. 11A).

In order to test this method in vivo the Cas9-VPR coding sequence needs to be split into two parts, delivered via two separate rAAV vectors and reconstituted in the target cells, i.e. the photoreceptors. However, an efficient reconstitution of Cas9-VPR is a key factor for an efficient treatment. Therefore, two different reconstitution strategies have been compared in this experiment: the split intein approach enabling reconstitution at the protein level (FIG. 11B) and the mRNA trans-splicing (REVeRT) approach (FIG. 11C) enabling reconstitution at the RNA level.

Figure 11:
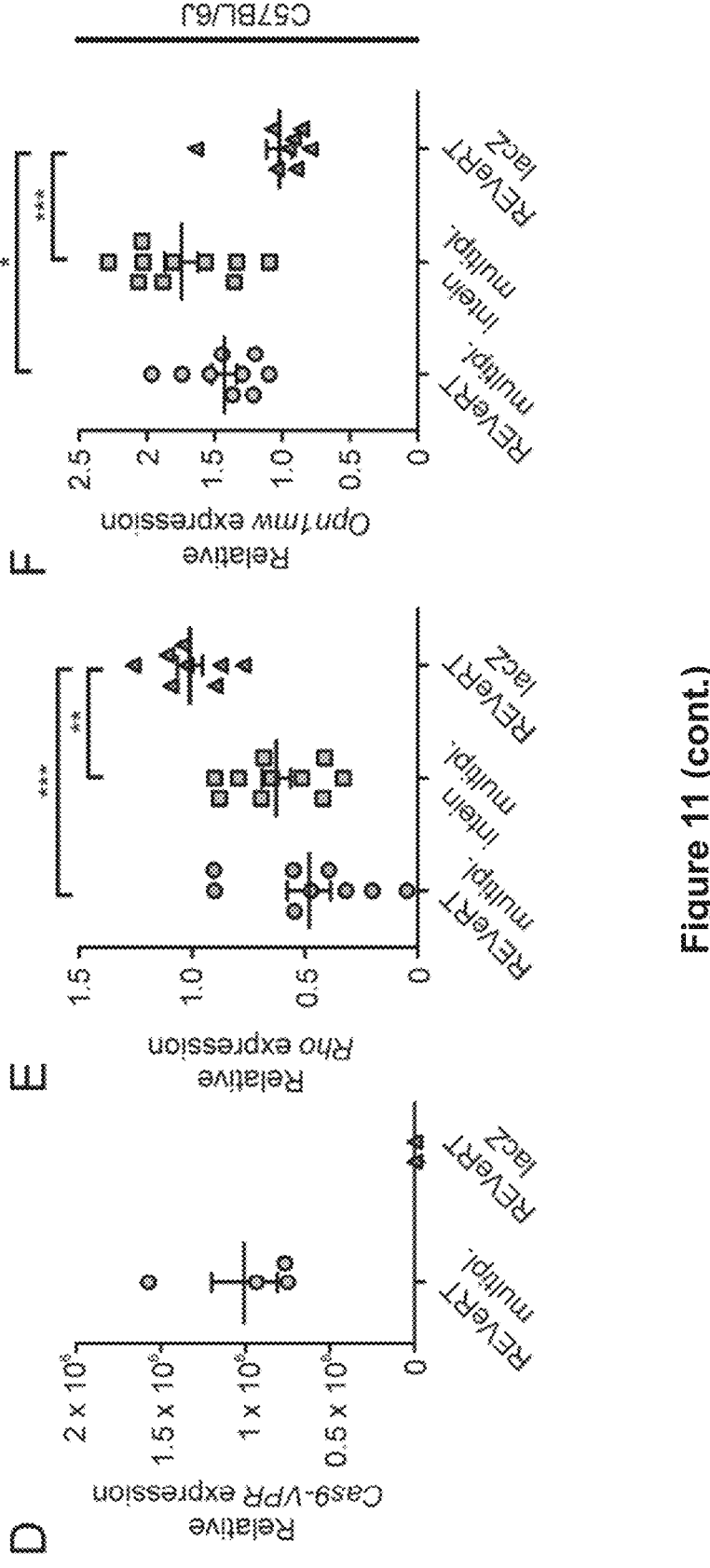
FIG. 11 shows a multiplexing approach using three guideRNAs for simultaneous Rho knockdown (i.e. deactivation) and Opn1mw activation. A Rho knockdown can be achieved by using single guideRNAs (sgRNAs) with a protospacer (PS)>16 bp, which retains the Cas9 catalytic activity. By contrast, Opn1mw activation can be achieved in presence of sgRNAs with a short protospacer sequence (<16 bp). Under these conditions Cas9 is capable of binding, but incapable of cutting the DNA. B, C rAAV cassettes used for reconstituting the split Cas9 either at the protein level using split inteins (B) or at the RNA level using the mRNA trans-splicing (REVeRT) approach (C). ITR means inverted terminal repeats. g1-g3 means the gRNAs described in A. U6 means U6 promoter. N-Int and C-Int is the N- or C-terminal part of the split intein. Rho means human rhodopsin promoter, SDS means splice donor site, SAS means splice acceptor site, pA means polyadenylation signal, BD means binding domain. D-F qRT-PCR analyses from retinas of wild type mice injected with the dual rAAVs expressing the SpCas9-VPR cassette shown in B (intein) or C (REVeRT) in presence of two Opn1mw gRNAs and one Rho gRNA (multiplexing approach), or in presence of only one single lacZ sgRNA.

For this experiment, 2-month-old C57BL/6J wild type mice were injected with AAVs containing split Cas9-VPR constructs in combination with two Opn1mw-targeting gRNAs and one Rho-targeting gRNA (multiplexing approach), or in combination with one single lacZ-targeting control gRNA (FIG. 11B, C). Four weeks post-injection, RNA was extracted from the retinas and analyzed via qRT-PCR. The results show that Cas9-VPR was reconstituted successfully via REVeRT at high levels (FIG. 11D). Reconstitution via split inteins could not be evaluated as it is taking place after translation into protein. Moreover, the inventors could show an efficient Rho knockdown as well as Opn1mw activation irrespective of the employed reconstitution strategy (FIG. 11E, F). These results emphasize the broad applicability of the described invention and shows its suitability for treatment of diseases caused by gain-of-function and dominant-negative diseases.

REFERENCES al-Ubaidi M R, Hollyfield J G, Overbeek P A, Baehr W. 1992. Photoreceptor degeneration induced by the expression of simian virus 40 large tumor antigen in the retina of transgenic mice. *Proceedings of the National Academy of Sciences of the United States of America* 89: 1194-8

Albert S, Garanto A, Sangermano R, Khan M, Bax N M, et al. 2018. Identification and Rescue of Splice Defects Caused by Two Neighboring Deep-Intronic ABCA4 Mutations Underlying Stargardt Disease. *Am J Hum Genet* 102: 517-27

Audo I, Bujakowska K M, Leveillard T, Mohand-Said S, Lancelot M E, et al. 2012. Development and application of a next-generation-sequencing (NGS) approach to detect known and novel gene defects underlying retinal diseases. *Orphanet J Rare Dis* 7: 8

Baralle D, Buratti E. 2017. RNA splicing in human disease and in the clinic. *Clin Sci* (Lond) 131: 355-68

Bax N M, Sangermano R, Roosing S, Thiadens A A, Hoefsloot L H, et al. 2015. Heterozygous deep-intronic variants and deletions in ABCA4 in persons with retinal dystrophies and one exonic ABCA4 variant. *Hum Mutat* 36: 43-7

Bergsma A J, van der Wal E, Broeders M, van der Ploeg A T, Pim Pijnappel VWVM. 2018. Alternative Splicing in Genetic Diseases: Improved Diagnosis and Novel Treatment Options. *Int Rev Cell Mol Biol* 335: 85-141

Biel M, Seeliger M, Pfeifer A, Kohler K, Gerstner A, et al. 1999. Selective loss of cone function in mice lacking the cyclic nucleotide-gated channel CNG3. *Proceedings of the National Academy of Sciences of the United States of America* 96: 7553-7

Boye S E, Boye S L, Lewin A S, Hauswirth W W. 2013. A comprehensive review of retinal gene therapy. *Molecular therapy: the journal of the American Society of Gene Therapy* 21: 509-19

Braun T A, Mullins R F, Wagner A H, Andorf J L, Johnston R M, et al. 2013. Non-exomic and synonymous variants in ABCA4 are an important cause of Stargardt disease. *Human molecular genetics* 22: 5136-45

Carss K J, Arno G, Erwood M, Stephens J, Sanchis-Juan A, et al. 2017. Comprehensive Rare Variant Analysis via Whole-Genome Sequencing to Determine the Molecular Pathology of Inherited Retinal Disease. *Am J Hum Genet* 100: 75-90

Chamberlain K, Riyad J M, Weber T. 2016. Expressing Transgenes That Exceed the Packaging Capacity of Adeno-Associated Virus Capsids. *Hum Gene Ther Methods* 27: 1-12

Chavez A, Scheiman J, Vora S, Pruitt B W, Tuttle M, et al. 2015. Highly efficient Cas9-mediated transcriptional programming. *Nat Methods* 12: 326-8

Chavez A, Tuttle M, Pruitt B W, Ewen-Campen B, Chari R, et al. 2016. Comparison of Cas9 activators in multiple species. *Nat Methods* 13: 563-7

Chen C C, Keller M, Hess M, Schiffmann R, Urban N, et al. 2014. A small molecule restores function to TRPML1 mutant isoforms responsible for mucolipidosis type IV. *Nat Commun* 5:4681

Chew W L, Tabebordbar M, Cheng J K, Mali P, Wu E Y, et al. 2016. A multifunctional AAV-CRISPR-Cas9 and its host response. *Nat Methods* 13: 868-74

Daiger S P, Sullivan L S, Bowne S J. 2013. Genes and mutations causing retinitis pigmentosa. *Clin Genet* 84: 132-41

Finn J T, Krautwurst D, Schroeder J E, Chen T Y, Reed R R, Yau K W. 1998. Functional co-assembly among subunits of cyclic-nucleotide-activated, nonselective cation channels, and across species from nematode to human. *Biophys J* 74: 1333-45

Flotte T R. 2000. Size does matter: overcoming the adeno-associated virus packaging limit. *Respir Res* 1: 16-8

Fu Y, Kefalov V, Luo D G, Xue T, Yau K W. 2008. Quantal noise from human red cone pigment. *Nat Neurosci* 11: 565-71

Gerstner A, Zong X, Hofmann F, Biel M. 2000. Molecular cloning and functional characterization of a new modulatory cyclic nucleotide-gated channel subunit from mouse retina. *J Neurosci* 20: 1324-32

Godfrey C, Desviat L R, Smedsrod B, Pietri-Rouxel F, Denti M A, et al. 2017. Delivery is key: lessons learnt from developing splice-switching antisense therapies. *EMBO Mol Med* 9: 545-57

Grodecka L, Buratti E, Freiberger T. 2017. Mutations of Pre-mRNA Splicing Regulatory Elements: Are Predictions Moving Forward to Clinical Diagnostics? *Int J Mol Sci* 18

Huang L, Mao Y, Yang J, Li Y, Li Y, Yang Z. 2018. Mutation screening of the USH2A gene in retinitis pigmentosa and USHER patients in a Han Chinese population. *Eye* (Lond) 32: 1608-14

Humphries M M, Rancourt D, Farrar G J, Kenna P, Hazel M, et al. 1997. Retinopathy induced in mice by targeted disruption of the rhodopsin gene. *Nat Genet* 15: 216-9

Kefalov V J. 2012. Rod and cone visual pigments and phototransduction through pharmacological, genetic, and physiological approaches. *J Biol Chem* 287: 1635-41

Khan A O, Becirovic E, Betz C, Neuhaus C, Altmuller J, et al. 2017. A deep intronic CLRN1 (USH3A) founder mutation generates an aberrant exon and underlies severe Usher syndrome on the Arabian Peninsula. *Sci Rep* 7: 1411

Kim H K, Pham MHC, Ko K S, Rhee B D, Han J. 2018. Alternative splicing isoforms in health and disease. *Pflugers Arch* 470: 995-1016

Koch S, Sothilingam V, Garcia Garrido M, Tanimoto N, Becirovic E, et al. 2012. Gene therapy restores vision and delays degeneration in the CNGB1(−/−) mouse model of retinitis pigmentosa. *Human molecular genetics* 21: 4486-96

Liguori A, Vache C, Baux D, Blanchet C, Hamel C, et al. 2016. Whole USH2A Gene Sequencing Identifies Several New Deep Intronic Mutations. *Hum Mutat* 37: 184-93

Mayer A K, Rohrschneider K, Strom T M, Glockle N, Kohl S, et al. 2016. Homozygosity mapping and whole-genome sequencing reveals a deep intronic PROM 1 mutation causing cone-rod dystrophy by pseudoexon activation. *Eur J Hum Genet* 24: 459-62

Michalakis S, Mühlfriedel R, Tanimoto N, Krishnamoorthy V, Koch S, et al. 2010. Restoration of cone vision in the CNGA3−/− mouse model of congenital complete lack of cone photoreceptor function. *Molecular therapy: the journal of the American Society of Gene Therapy* 18: 2057-63

Michalakis S, SchÖn C, Becirovic E, Biel M. 2017. Gene Therapy for Achromatopsia. *J Gene Med*

Naruto T, Okamoto N, Masuda K, Endo T, Hatsukawa Y, et al. 2015. Deep intronic GPR143 mutation in a Japanese family with ocular albinism. *Sci Rep* 5: 11334

Ohno K, Takeda J I, Masuda A. 2018. Rules and tools to predict the splicing effects of exonic and intronic mutations. *Wiley Interdiscip Rev RNA* 9

Rio Frio T, McGee T L, Wade N M, Iseli C, Beckmann J S, et al. 2009. A single-base substitution within an intronic repetitive element causes dominant retinitis pigmentosa with reduced penetrance. *Hum Mutat* 30: 1340-7

Sakurai K, Onishi A, Imai H, Chisaka O, Ueda Y, et al. 2007. Physiological properties of rod photoreceptor cells in green-sensitive cone pigment knock-in mice. *J Gen Physiol* 130: 21-40

Sancho-Pelluz J, Arango-Gonzalez B, Kustermann S, Romero F J, van Veen T, Zrenner E, Ekstrom P, Paquet-Durand F. 2008, Photoreceptor cell death mechanisms in inherited retinal degeneration. *Mol Neurobiol* 38, 253-269

Sander J D, Joung J K. 2014. CRISPR-Cas systems for editing, regulating and targeting genomes. *Nat Biotechnol* 32: 347-55

Sautter A, Zong X, Hofmann F, Biel M. 1998. An isoform of the rod photoreceptor cyclic nucleotide-gated channel beta subunit expressed in olfactory neurons. *Proceedings of the National Academy of Sciences of the United States of America* 95: 4696-701

Scholl H P, Strauss R W, Singh M S, Dalkara D, Roska B, et al. 2016. Emerging therapies for inherited retinal degeneration. *Sci Transl Med* 8: 368rv6

Shanks M E, Downes S M, Copley R R, Lise S, Broxholme J, et al. 2013. Next-generation sequencing (NGS) as a diagnostic tool for retinal degeneration reveals a much higher detection rate in early-onset disease. *Eur J Hum Genet* 21: 274-80

Shi G, Yau K W, Chen J, Kefalov V J. 2007. Signaling properties of a short-wave cone visual pigment and its role in phototransduction. *J Neurosci* 27: 10084-93

Truong D J, Kuhner K, Kuhn R, Werfel S, Engelhardt S, et al. 2015. Development of an intein-mediated split-Cas9 system for gene therapy. *Nucleic Acids Res* 43: 6450-8

Vache C, Besnard T, le Berre P, Garcia-Garcia G, Baux D, et al. 2012. Usher syndrome type 2 caused by activation of an USH2A pseudoexon: implications for diagnosis and therapy. *Hum Mutat* 33: 104-8

Wang H, La Russa M, Qi L S. 2016. CRISPR/Cas9 in Genome Editing and Beyond. *Annu Rev Biochem* 85: 227-64

Webb T R, Parfitt D A, Gardner J C, Martinez A, Bevilacqua D, et al. 2012. Deep intronic mutation in OFD1, identified by targeted genomic next-generation sequencing, causes a severe form of X-linked retinitis pigmentosa (RP23). *Human molecular genetics* 21: 3647-54

Wu Z, Yang H, Colosi P. 2010. Effect of genome size on AAV vector packaging. *Molecular therapy: the journal of the American Society of Gene Therapy* 18: 80-6

SEQUENCE LISTING (127 sequences)

SEQ ID NO: 1 - DNA, 6786 bp, Homo sapiens
atggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccaaaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatga

SEQ ID NO: 2 - protein, 2261 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGQYGIPRPWYFPCTKSYWFGEESDEKSHPGSNQKRISEICMEEEPTHLKLGVSIQNLVKVYRDGMKVAVDGLALNFYEGQITSFLGHNGAGKTTTMSILTGLFPPTSGTAYILGKDIRSEMSTIRQNLGVCPQHNVLFDMLTVEEHIWFYARLKGLSEKHVKAEMEQMALDVGLPSSKLKSKTSQLSGGMQRKLSVALAFVGGSKVVILDEPTAGVDPYSRRGIWELLLKYRQGRTIILSTHHMDEADVLGDRIAIISHGKLCCVGSSLFLKNQLGTGYYLTLVKKDVESSLSSCRNSSSTVSYLKKEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDAIKQMKKHLKLAKDSSADRFLNSLGRFMTGLDTKNNVKVWFNNKGWHAISSFLNVINNAILRANLQKGENPSHYGITAFNHPLNLTKQQLSEVALMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMVKNQAMADALERFGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 3 - DNA, 7311 bp, Homo sapiens
atgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgatgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatccttgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctga

SEQ ID NO: 4 - protein, 2436 aa, Homo sapiens
MGFLHQLQLLLWKNVTLKRRSPWVLAFEIFIPLVLFFILLGLRQKKPTISVKEVSFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 5 - DNA, 6822 bp, Homo sapiens
atgggcttcgtgagacagatacagcttttgctctggaagaactggaccctgcggaaaaggcaaaagattcgctttgtggtggaactcgtgtggcctttatctttatttctggtcttgatctggttaaggaatgccaacccactctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggtggcatgcagagaaagctgtcggttgccattgcctttgtgggagatgccaaggtggtgattctggacgaacccacctctggggtggacccttactcgagacgctcaatctgggatctgctcctgaagtatcgctcaggcagaaccatcatcatgtccactcaccacatggacgaggccgacctccttggggaccgcattgccatcattgcccagggaaggctctactgctcaggcaccccactcttcctgaagaactgctttggcacaggcttgtacttaaccttggtgcgcaagatgaaaaacatccagagccaaaggaaaggcagtgaggggacctgcagctgctcgtctaagggtttctccaccacgtgtccagcccacgtcgatgacctaactccagaacaagtcctggatggggatgtaaatgagctgatggatgtagttctccaccatgttccagaggcaaagctggtggagtgcattggtcaagaacttatcttccttcttccaaataagaacttcaagcacagagcatatgccagccttttcagagagctggaggagacgctggctgaccttggtctcagcagttttggaatttctgacactcccctggaagagatttttctgaaggtcacggaggattctgattcaggacctctgtttgcgggtggcgctcagcagaaaagagaaaacgtcaacccccgacacccctgcttgggtcccagagagaaggctggacagacaccccaggactccaatgtctgctccccaggggcgccggctgctcacccagagggccagcctcccccagagccagagtgcccaggcccgcagctcaacacggggacacagctggtcctccagcatgtgcaggcgctgctggtcaagagattccaacacaccatccgcagccacaaggacttcctggcgcagatcgtgctcccggctacctttgtgtttttggctctgatgctttctattgttatccctccttttggcgaataccccgctttgacccttcacccctggatatatgggcagcagtacaccttcttcagcatggatgaaccaggcagtgagcagttcacggtacttgcagacgtcctcctgaataagccaggctttggcaaccgctgcctgaaggaagggtggcttccggagtacccctgtggcaactcaacaccctggaagactccttctgtgtccccaaacatcacccagctgttccagaagcagaaatggacacaggtcaacccttcaccatcctgcaggtgcagcaccagggagaagctcaccatgctgccagagtgccccgagggtgccgggggcctcccgcccccccagagaacacagcgcagcacggaaattctacaagacctgacggacaggaacatctccgacttcttggtaaaaacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaattgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactga

SEQ ID NO: 6 - protein, 2273 aa, Homo sapiens [sequence omitted]

SEQ ID NO: 7 - DNA, 6441 bp, Homo sapiens
atggccttctggacacagctgatgctgctgctctggaagaatttcatgtatcgccggagacagccggtccagctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacggcccagcctcaaccaaccaagcagtctccactggaaccacccatgctggatgtcgcggagctgctgacgtcactgctgcgcacggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtgaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggccgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctacggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccggcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcagatacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggatgctcaggacagtctcaagatctggttcaacaacaaaggctggcactccatggtggcctttgtcaaccgagccagcaacgcaatcctccgtgctcacctgcccccaggcccggcccgccacgcccacagcatcaccacactcaaccaccccttgaacctcaccaaggagcagctgtctgagggtgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctggccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctggggcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctga

SEQ ID NO: 8 - protein, 2146 aa, Homo sapiens
MAFWTQLMLLLWKNFMYRRRQPVQLLVELLWPLFLFFILVAVRHSHPPLEHHECHFPNKPLPSAGTVPWLQGLICNVNNTCFPQLTPGEEPGRLSNFNDSLVSRLLADARTVLGGASAHRTLAGLGKLIATLRAARSTAQPQPTKQSPLEPPMLDVAELLTSLLRTESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSRPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGPARHAHSITTLNHPLNLTKEQLSEGALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHSMEECEALCSRLAIMVNGRFRCLGSPQHLKGRFAAGHTLTLRVPAARSQPAAAFVAAEFPGAELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 9 - DNA, 7788 bp, Homo sapiens
atggcttccctgtttcatcagcttcagatcctggtctggaaaaattggctaggtgtaaaaaggcagccgctttggacacttgtcttgatcttatggccagtcattattttcataattttggctattactcggaccaaatttcctccaactgcaaaaccaacttgttacctcgcacctcgaaaccttcctagtactggattctttccattcctgcagaccctactctgtgacacagactctaaatgcaaagacacaccctatggcccacaagatctgcttcgtaggaaaggaattgatgatgcactatttaaagacagtgagattctgagaaagtcatccaacctggataaggacagcagtttatcattccagagcacccaagttccagaaagaaggcatgcatcactagccacagtatttcccagtccaagttctgatttggaaatccccggaacatatactttcaatggcagtcaagtgctcgcacgaattcttggcttggaaaagctgttaaagcaaaattcaacttcagaagatatacgaagagaactatgtgacagctattcaggatacattgtggatgatgccttctcttggacctttctaggaagaaatgtttttaacaaattttgcctttctaacatgacccttttagagtcttctctccaagaactaaacaaacagttctcccagctatccagtgaccccaacaatcagaagatagtgtttcaggaaatagtcagaatgctgtctttcttctcacaagtgcaagagcagaaagctgtgtggcagcttctgtctagttttccaaatgtgtttcagaatgacacatcactaagcaatctatttgatgttcttcgaaaggcaaacagtgtgctgctggttgtgcagaaggtttatccacgttttgcaactaacgaaggtttcagaaccctccagaagtctgttaaacatctgctgtacactctggactccccagctcaaggtgactccgataatataacgcatgtgtggaatgaggatgatggacagaccttatctccaagcagtctggctgcacagctcctaattctggaaaactttgaagatgccctcttaaatatatcagcaaatagtccttatattccttacttggcatgtgtgagaaatgtgactgacagtttggccagaggttcaccagaaaatctaagactcctgcagtccacaatacgatttaaaaaatcttttcttcgcaatggttcctatgaagattactttcctccagttcctgaagtcctaaaatcaaaactgtctcaacttcgaaacttgaccgaacttctttgtgaatctgaaactttcagtttgatagagaagtcatgccagctctctgatatgagctttgggagcctgtgtgaagaaagtgagtttgatctgcaactcctcgaagcggcagagctgggcaccgaaatagcagccagcttactgtaccatgacaatgtcatatctaaaaaagtgagagatttgctgactggagatccaagcaaaattaatttaaatatggatcagtttctagaacaggcactgcaaatgaattacttggaaaatatcactcagttaataccgatcatagaagccatgctgcatgtcaataacagtgcagatgcttctgaaaagccaggtcagttactagaaatgtttaaaaatgttgaagagctgaaagaagatttaaggagaacaacaggaatgtccaacaggactattgacaagttgctggccattcccatccctgataatagagctgagattatttctcaggtgttctggctgcattcctgtgatactaatatcaccactcccaaactagaagatgcaatgaaagaattctgcaacctgtctctttcagagagatcccggcagtcttacctcatcggactcacccttctgcactacttaaacatttacaacttcacatacaaggtgtttttcccgaggaaagatcaaaagccagtagaaaagatgatggagctcttcataagactaaaagagattctcaatcagatggcttctggcacacatccgctgctagacaaaatgagatccctgaagcaaatgcatctgcccagaagtgttccattaacacaggcaatgtacagaagcaaccgaatgaacacaccacaaggatcatttagcaccatctcccaagcattatgttctcaaggaattaccactgaatatttaactgccatgctgccctcttcccagaggccaaaaggcaaccacaccaaggattttttgacttataaattaactaaagagcaaattgcttcaaaatatggaattcccataaattccacaccattttgcttctccctttataaagacatcattaacatgcccgctggacctgtgatttgggctttcttgaaacctatgttgttgggaagaattttgtatgcaccatataacccagtcacaaaggcaataatggaaaagtccaatgtaactctgagacagctggcggaattaagagaaaaatctcaagagtggatggataagtcgccacttttcatgaattccttccatctgttaaaccaggcaattccaatgctccagaatactctaaggaacccttttgtgcaagtttttgtaaagttctccgtgggactcgatgctgttgaactattgaaacagatagatgaactcgatattctaagactgaaattagagaacaacattgacatcatcgatcagcttaacacactatcttccctgacagtaaatatttcctcttgtgtattatatgaccgtattcaggcagcaaaaaccatagatgaaatggagagagaggctaaaaggctctacaaaagcaacgaactctttggaagtgttatttttaagcttccttctaacagaagctggcacagaggctatgactctggaaatgtctttcttcctcctgtcataaaatataccatccggatgagtctcaagaccgcacagaccacaagaagcctaagaaccaagatttgggctccagggccacacaattctccatcacacaaccagatctatggcagggcttttatttatttacaggatagtattgaaagagcaatcattgaattgcaaactggaaggaactcccaggaaatagcagtccaggttcaagcaattccttatccctgcttcatgaaagacaacttcctaaccagtgtctcttattctcttccaattgtgcttatggttgcctgggttgtatttatagctgcctttgtaaaaaagcttgtctatgagaaagacctccggcttcatgagtacatgaagatgatgggtgtgaactcctgcagccatttctttgcctggcttatagagagtgttggatttttactggttaccatcgtgatcctcatcattatactcaagtttggcaatattcttcctaaaacaaatgggttcattttgttcctgtatttttcggactacagcttctcggttattgccatgagctatcttatcagtgtcttcttcaacaacaccaacattgcagctctgatcggaagcctcatctacatcattgccttctttccatttattgttctggttacagtggagaatgagttgagctatgtattgaaagtgttcatgagcctgctgtccccaacagcattcagctatgcaagccaatacattgcacgatacgaagaacagggcattggtcttcagtgggaaaatatgtacacctccccggttcaggatgacaccacctcatttggctggctgtgctgtctaatcctagctgactctttcatttatttccttattgcttggtatgtcaggaatgtcttcccagggacatacggtatggcagctccctggtattttccaattcttccttcctattggaaggagcgatttgggtgtgcagaggtgaagcctgagaagagcaatggcctcatgtttactaacatcatgatgcagaacaccaacccatctgccagtcctgaatacatgttttcctctaacatcgagcctgaacctaaagatctcacagtcggggttgccctgcatggggtcacaaagatctatggctcaaaagttgctgttgataacctcaatctgaacttttatgaagggcatattacttcattgctggggcccaatggagctgggaaaactactaccatttccatgttaactgggctgtttggggcctcagcaggcaccatttttgtatatggaaaagatatcaaaacagacctacacacggtacggaagaacatgggagtctgtatgcagcacgacgtcttgttcagttacctcactactaaggagcaccttctcctatatggttccatcaaagttcctcactggactaaaaagcagctccacgaggaagtaaaaaggactttaaaagatactggactatatagccatcgtcataagagagttggaacactgtcaggaggcatgaagaggaagttatctatatccatagctctcattggtggatcaagggtagtaattttggatgaaccatctactggagttgacccatgttctcgccgaagtatatgggatgttatatccaagaacaaaactgccagaacaatcattctgtcaacgcaccacttggacgaggctgaagtgctgagtgaccgcatcgccttcctggagcagggtgggcttaggtgctgtgggtccccattttacctcaaggaagcctttggcgatgggtatcacctcacgcttaccaagaagaagagtccaaatttaaatgcaaatgcagtatgtgacaccatggccgtgacagcaatgatccaatcacatctccccgaagcctacctcaaggaggatattgggggagagcttgtttatgtacttcctccattcagcaccaaagtctcaggggcctacctgtcactcctacgggcactcgacaatggcatgggtgacctcaacatcgggtgctacggcatttcagataccaccgtggaggaggtctttctgaacttgaccaaagagtcacaaaaaaatagtgctatgagtcttgagcacttaacacaaaagaaaattgggaattccaatgccaatggcatctcaactcctgacgatttatctgtgagcagcagcaatttcacagacagagatgacaaaatcctgacaagaggagagaggctggatggctttggactgttgctgaagaagatcatggctatactcatcaagaggttccaccacacccgcaggaactggaaaggtctcattgctcaggttatcctccccatcgtctttgttaccactgccatgggccttggcacactgagaaattccagcaacagttatccagagattcagatctccccctctctttatggtacctccgaacagacagccttctatgctaattatcacccgagcacggaagcacttgtctcagcaatgtgggacttccctggaattgacaacatgtgtctgaacaccagtgatctacagtgtttaaacaaagacagtctggaaaaatggaacaccagtggagaacccatcactaattttggtgtttgctcctgctcagaaaatgtccaggaatgtcctaaatttaactattccccaccgcacagaagaacttactcatcccaggtaatttataacctcactgggcaacgagtggaaaattatcttatatcaactgcaaatgagtttgtccaaaaaagatatggaggttggagttttgggctgcctttgacaaaagaccttcgttttgatataacaggagtccctgccaatagaacacttgccaaggtatggtatgatccagaaggctatcactcccttccagcttacctcaacagcctgaataatttccttctgcgagttaacatgtcaaaatacgatgctgcccgacatggcatcatcatgtatagccatccttatccaggagtgcaagaccaagaacaagccacaatcagcagtttaatcgatattttagtggcactgtctatcttgatgggctactctgtcaccaccgccagctttgtcacctatgttgtaagggaacatcaaaccaaagccaaacagttgcagcacatttcaggcattggcgtgacatgctactgggtaacaaacttcatttatgacatggttttctacttggtgcctgtagcgttttcaattggtatcattgcgattttcaaattacctgcattctacagtgaaaacaacctaggcgctgtatctctcctacttctcctgtttgggtatgcaacattttcctggatgtacttgctggctgggctcttccatgaaacaggaatggccttcatcacttacgtctgtgtcaacttgttttttggcattaattccattgtttccctgtcagtggtatactttctttccaaggaaaagcctaatgatccgactttagaacttatttctgaaaccctcaagcgcattttcctgattttcccacaattctgttttggctacggtttgattgaactttctcaacaacagtcggtcctagacttcttaaaagcatatggagtggaatacccaaatgaaacctttgagatgaataaactaggtgcaatgtttgtggctttggtttctcagggcaccatgtttttttccttgcgactcttaatcaacgaatccctgataaagaaactcaggcttttcttcagaaaatttaattcttcacatgtaagggagacaatagatgaggatgaagatgtgcgggctgagagattaagagttgagagtggtgcagctgaatttgacttggtccaactttattgtctcacaaagacctaccaacttatccacaaaaagattatagctgtaaacaacatcagcattgggatacctgctggagagtgttttgggcttcttggagtgaatggagcaggaaagaccactatattcaagatgctgacaggagacatcattccttcaagtggaaacattctgatcagaaataagaccggatctctgggtcacgttgattctcacagctcattagttggctactgtcctcaggaagatgccttagatgacctggtaactgtggaagaacatttgtatttctatgccagggtacatggaattccagaaaaggatattaaagaaactgttcataaactccttaggagacttcacctgatgcccttcaaggacagagctacctctatgtgcagttatggcacaaaaagaaaattatccactgcactggccttgatagggaaaccttccattctactgctggatgagccgagctctggcatggatccgaagtcgaaacggcacctctggaagatcatttcagaagaagtacagaacaaatgttccgtcatcctcacatctcacagcatggaagaatgtgaagctctctgtaccaggttggccattatggtgaatggaaagtttcaatgtattggatctttgcagcacataaagagcaggtttggacgaggatttactgtcaaagttcacttgaagaataacaaagtgaccatggagaccctcacaaagttcatgcagctgcactttccaaaaacatacttaaaagatcagcacctcagcatgctagagtatcatgtaccagtcacagcaggaggagtcgcaaacatttttgatctgctggaaaccaacaagactgctttaaatattacaaatttcttagtgagtcagaccactctggaagaggttttcatcaactttgccaaagaccagaagtcctatgaaactgctgataccagcagccaaggttccactataagtgttgactcacaagatgaccagatggagtcttaa

SEQ ID NO: 10 - protein, 2595 aa, Homo sapiens
MASLFHQLQILVWKNWLGVKRQPLWTLVLILWPVIIFIILAITRTKFPPTAKPTCYLAPRNLPSTGFFPFLQTLLCDTDSKCKDTPYGPQDLLRRKGIDDALFKDSEILRKSSNLDKDSSLSFQSTQVPERRHASLATVFPSPSSDLEIPGTYTFNGSQVLARILGLEKLLKQNSTSEDIRRELCDSYSGYIVDDAFSWTFLGRNVFNKFCLSNMTLLESSLQELNKQFSQLSSDPNNQKIVFQEIVRMLSFFSQVQEQKAVWQLLSSFPNVFQNDTSLSNLFDVLRKANSVLLVVQKVYPRFATNEGFRTLQKSVKHLLYTLDSPAQGDSDNITHVWNEDDGQTLSPSSLAAQLLILENFEDALLNISANSPYIPYLACVRNVTDSLARGSPENLRLLQSTIRFKKSFLRNGSYEDYFPPVPEVLKSKLSQLRNLTELLCESETFSLIEKSCQLSDMSFGSLCEESEFDLQLLEAAELGTEIAASLLYHDNVISKKVRDLLTGDPSKINLNMDQFLEQALQMNYLENITQLIPIIEAMLHVNNSADASEKPGQLLEMFKNVEELKEDLRRTTGMSNRTIDKLLAIPIPDNRAEIISQVFWLHSCDTNITTPKLEDAMKEFCNLSLSERSRQSYLIGLTLLHYLNIYNFTYKVFFPRKDQKPVEKMMELFIRLKEILNQMASGTHPLLDKMRSLKQMHLPRSVPLTQAMYRSNRMNTPQGSFSTISQALCSQGITTEYLTAMLPSSQRPKGNHTKDFLTYKLTKEQIASKYGIPINSTPFCFSLYKDIINMPAGPVIWAFLKPMLLGRILYAPYNPVTKAIMEKSNVTLRQLAELREKSQEWMDKSPLFMNSFHLLNQAIPMLQNTLRNPFVQVFVKFSVGLDAVELLKQIDELDILRLKLENNIDIIDQLNTLSSLTVNISSCVLYDRIQAAKTIDEMEREAKRLYKSNELFGSVIFKLPSNRSWHRGYDSGNVFLPPVIKYTIRMSLKTAQTTRSLRTKIWAPGPHNSPSHNQIYGRAFIYLQDSIERAIIELQTGRNSQEIAVQVQAIPYPCFMKDNFLTSVSYSLPIVLMVAWVVFIAAFVKKLVYEKDLRLHEYMKMMGVNSCSHFFAWLIESVGFLLVTIVILIIILKFGNILPKTNGFILFLYFSDYSFSVIAMSYLISVFFNNTNIAALIGSLIYIIAFFPFIVLVTVENELSYVLKVFMSLLSPTAFSYASQYIARYEEQGIGLQWENMYTSPVQDDTTSFGWLCCLILADSFIYFLIAWYVRNVFPGTYGMAAPWYFPILPSYWKERFGCAEVKPEKSNGLMFTNIMMQNTNPSASPEYMFSSNIEPEPKDLTVGVALHGVTKIYGSKVAVDNLNLNFYEGHITSLLGPNGAGKTTTISMLTGLFGASAGTIFVYGKDIKTDLHTVRKNMGVCMQHDVLFSYLTTKEHLLLYGSIKVPHWTKKQLHEEVKRTLKDTGLYSHRHKRVGTLSGGMKRKLSISIALIGGSRVVILDEPSTGVDPCSRRSIWDVISKNKTARTIILSTHHLDEAEVLSDRIAFLEQGGLRCCGSPFYLKEAFGDGYHLTLTKKKSPNLNANAVCDTMAVTAMIQSHLPEAYLKEDIGGELVYVLPPFSTKVSGAYLSLLRALDNGMGDLNIGCYGISDTTVEEVFLNLTKESQKNSAMSLEHLTQKKIGNSNANGISTPDDLSVSSSNFTDRDDKILTRGERLDGFGLLLKKIMAILIKRFHHTRRNWKGLIAQVILPIVFVTTAMGLGTLRNSSNSYPEIQISPSLYGTSEQTAFYANYHPSTEALVSAMWDFPGIDNMCLNTSDLQCLNKDSLEKWNTSGEPITNFGVCSCSENVQECPKFNYSPPHRRTYSSQVIYNLTGQRVENYLISTANEFVQKRYGGWSFGLPLTKDLRFDITGVPANRTLAKVWYDPEGYHSLPAYLNSLNNFLLRVNMSKYDAARHGIIMYSHPYPGVQDQEQATISSLIDILVALSILMGYSVTTASFVTYVVREHQTKAKQLQHISGIGVTCYWVTNFIYDMVFYLVPVAFSIGIIAIFKLPAFYSENNLGAVSLLLLLFGYATFSWMYLLAGLFHETGMAFITYVCVNLFFGINSIVSLSVVYFLSKEKPNDPTLELISETLKRIFLIFPQFCFGYGLIELSQQQSVLDFLKAYGVEYPNETFEMNKLGAMFVALVSQGTMFFSLRLLINESLIKKLRLFFRKFNSSHVRETIDEDEDVRAERLRVESGAAEFDLVQLYCLTKTYQLIHKKIIAVNNISIGIPAGECFGLLGVNGAGKTTIFKMLTGDIIPSSGNILIRNKTGSLGHVDSHSSLVGYCPQEDALDDLVTVEEHLYFYARVHGIPEKDIKETVHKLLRRLHLMPFKDRATSMCSYGTKRKLSTALALIGKPSILLLDEPSSGMDPKSKRHLWKIISEEVQNKCSVILTSHSMEECEALCTRLAIMVNGKFQCIGSLQHIKSRFGRGFTVKVHLKNNKVTMETLTKFMQLHFPKTYLKDQHLSMLEYHVPVTAGGVANIFDLLETNKTALNITNFLVSQTTLEEVFINFAKDQKSYETADTSSQGSTISVDSQDDQMES

SEQ ID NO: 11 - DNA, 15177 bp, Homo sapiens
atggggcatgccgggtgccagttcaaagccctgctgtggaagaattggctctgcagactcaggaacccggtccttttccttgctgaattcttctggccttgtatcctgtttgtaattctgacagttcttcgttttcaagaacctcccagatacagagacatttgttatttgcagccccgagatctacccagctgtggtgttatcccctttgttcaaagccttctttgtaacactggatcaaggtgtaggaacttcagctatgaagggtcaatggagcatcattttcgtttgtctaggttccaaactgcagctgaccccaagaaagtcaacaacctggcctttttaaaagagatacaagacctggcagaggaaattcatggaatgatggacaaggcaaaaaacttaaaaagactttgggtagaacgatccaacactccagattcttcttatggttccagtttttttacaatggatctcaataagaccgaggaggtaatattgaaactggaaagcctccatcagcagcctcatatctgggattttctacttttactgccgagactacacacaagccatgatcatgtggaagatggcatggatgttgcagtgaaccttctccagaccattttgaattccttaatatccctagaagatttagattggcttccactcaaccaaactttttcccaggtttctgaacttgtactgaatgtgaccatttcgacactgacatttctgcagcaacatggagtagcagtcaccgagccagtttaccacctgtccatgcagaatatagtgtgggatccacagaaagtccagtatgatctcaaatcccagtttggctttgatgatcttcacacggaacagatcctgaactcttcagctgaactgaaggagattcccacagacacttccttggagaagatggtgtgttcagtcttgtctagcacatcagaggatgaagctgagaaatggggccacgttggaggctgccaccctaagtggtcagaagccaaaaactatcttgtccatgcagtcagctggctgcgagtctaccaacaggtgtttgttcagtggcaacagggtagcctgcttcagaagacactcacaggcatgggccatagtctggaggctctcaggaatcagtttgaagaagagagcaagccctggaaggtggtggaagctctgcacactgcactgctcctgctgaatgacagcttgtcagcagatggcccaaaagataatcatacatttccaaagatattacagcatctgtggaaattgcaaagcttgctgcaaaacctgccccagtggccggcactgaagagatttcttcagcttgatggagctctcagaaatgcgatagctcagaatttacattttgtccaagaagtcctcatttgcctggagacatcagctaatgattttaaatggtttgaacttaaccaattgaaactggaaaaggatgtgttcttttgggagctgaaacagatgttggcgaagaatgctgtctgcccgaatggtcgtttctctgagaaggaggtctttttgccgcctggaaactccagcatatggggtggtctccagggactgttgtgctattgtaactcctctgagacgagtgttttaaacaagctacttggttcagtagaggatgctgatcgtattttgcaagaggtcattacttggcacaaaaatatgtcagttttaatacctgaagaatatttggactggcaggaacttgagatgcagctgtcagaagcaagcctttcctgtactcggctcttcctgctgctgggagctgatccctctcctgagaatgatgtcttttctagtgactgtaagcaccagcttgtctccacagtgatatttcatacacttgaaaaaacacaatttttcctggaacaagcatattattggaaagccttcaaaaagtttatcaggaagacttgcgaagtggcccaatatgtaaatatgcaagagagtttccagaacagactattggcttttcctgaggaatctccttgttttgaagaaaacatggattggaaaatgatcagtgataattattttcaatttttgaataacttactcaagtctccaacagcttccatatccagggctttaaatttcacaaagcaccttctaatgatggaaaagaagttgcacacccttgaggatgaacaaatgaactttcttttatcatttgtggaattttttgagaaattattgttgcctaatctttttgactcctccattgttcccagtttccacagcctcccatctctcacagaggatattctgaatataagttctctgtggacaaatcatttaaaaagtttaaagagagacccatctgccactgatgctcagaaactcttggaatttggcaacgaagtgatttggaaaatgcagactctcggaagtcactggataaggaaggaaccaaaaaatcttttgagattcatagaattaatactttttgaaattaatcccaaattactagaattatgggcctatggcatttcaaaaggaaaaagagctaaattggaaaacttctttacacttttaaatttttctgttccagaaaatgagattctgagtacaagttttaacttttcccagttgttccattcagattggcctaaatcaccagctatgaacatagattttgtacgtttaagtgaggctataataactagtctccatgaatttggatttttggagcaggaacagatctcagaagctctgaacacagtctacgctatcaggaatgcatctgatcttttctcagccctttctgaaccacaaaaacaagaagttgataaaattttgactcacatacacctaaatgtcttccaggacaaggattcagctttacttctgcaaatttattcttcattttaccgatatatttatgaattattgaatattcagagtagaggctcttcgttgactttccttacacaaatctcaaaacacattttggatatcataaaacaatttaatttccaaaacatcagtaaagcatttgcatttttatttaagacagcagaggttcttgggggaatttctaatgtatcttactgtcagcaattgctttcaatttttaactttttggagcttcaggcccaatccttcatgtctacagagggccaagaactggaagtgatccacactactttgacaggcctcaaacagctgctcataattgatgaagattttcgtatttctttatttcaatatatgagccaattcttcaacagttcagtagaagacctattggataataaatgcttgatttcggacaataaacacatttcttccgtaaattattcaacaagtgaggagtcttcatttgtttttccattggcacaaattttttcaaacctctcagcaaatgtcagtgtgttcaacaagtttatgtccattcactgtaccgtttcatggcttcaaatgtggactgaaatctgggaaaccatatctcaattatttaagtttgacatgaatgttttcacatctcttcatcatggtttcactcagcttttggatgaattggaagatgatgtgaaagtctctaaaagctgccagggtatacttcccacccataatgttgctagactcatattaaatttgtttaaaaatgtaactcaagccaatgacttccataattgggaggacttcctggatctcagggattttttggtagctttaggtaatgcattagtttcagtaaaaaaacttaacttggagcaagtggagaaatcccttttcaccatggaagctgccctgcatcagttgaagacatttccattcaacgaaagtacaagcagagagtttttaaattctctgcttgaagttttcattgagtttagcagtacctcagaatatatagtcagaaatctagattcaataaatgactttctttcaaataatctcacaaattatggagaaaaatttgaaaatatcatcactgagctaagagaagcaatagtatttcttagaaatgtatcacatgatcgagatttgttttcctgtgctgatattttccaaaatgttactgagtgtattttagaagatggctttttatatgtaaatacctcacagaggatgttacgtattctagacacgttaaattccacattttcctctgagaacacaattagcagtctgaaaggatgcattgtatggttagatgtcataaaccatttgtatttgttgtctaactccagtttttcacaaggtcatcttcaaaatattttggggaatttcagagatatagaaaacaaaatgaactctatattaaaaattgtaacttgggtgttaaatataaaaaaacctctttgttcatcaaatggctcacatataaattgtgtcaatatttacttgaaagatgtaactgactttctaaatattgtacttactacagtctttgaaaaagagaagaaacctaaatttgagattttattagctcttttaaatgattccacaaagcaagtaaggatgagtatcaacaacttaacaacagactttgattttgcatctcagtccaattggagatattttactgaattaattctaagaccaatagaaatgtcagatgaaattcctaatcagtttcaaaatatttggcttcatttaataacactggggaaggaatttcagaagcttgtaaaaggtatttactttaacatcctggaaaataattcctcttctaaaactgaaaacttgttaaacatatttgccaccagtccaaaagaaaaggatgtaaacagtgtaggcaattccatttatcacttagctagttaccttgccttcagcttatctcatgacctccaaaattcaccaaaaataataatttcacctgaaataatgaaagctacaggtcttggtattcaactgataagggatgtgttcaactccttaatgcctgtagttcatcacactagtccacaaaatgcaggttatatgcaagctttgaagaaggtaacttctgtcatgcgtacccttaagaaggcagacatagaccttttagtggatcagcttgaacaagttagtgtaaacctaatggatttctttaagaatatcagtagtgtgggaactggcaatttagtggtcaatttgcttgttggcttgatggaaaaatttgcagacagctcacattcttggaatgttaatcatctgctgcagctctcacgcctgtttcctaaagatgttgtggatgctgtgatagatgtgtactatgtgcttcctcatgctgtaaggctcctgcagggagtacctggtaaaaacatcactgaaggcctcaaggatgtctacagcttcacactccttcatggcataaccatttcaaatatcaccaaggaagacttcgcaattgtgataaaaattcttttggatacaattgaattagtatcagataagccagatattatttcagaggctttagcttgttttcctgtggtttggtgctggaatcacacaaattctggatttcggcagaattcaaagatagacccctgcaatgtccatgggctcatgtcttcttccttttatggcaaagtggccagtatacttgatcatttccacctgtctccccaaggtgaagattcaccatgttcaaatgaaagctcccgaatggaaataactaggaaagtggtctgcataattcatgaattagtggactggaattctattcttctggagctctctgaagtcttccatgttaacatttctcttgtgaaaactgtgcagaaattttggcataagatattaccgtttgtcccaccttcaataaatcaaactagggatagcatctctgaactctgtcctagtggttccataaagcaagttgctttgcaaatcatagaaaaacttaaaaatgtcaactttacaaaagttacatcaggtgaaaatattcttgacaaactaagtagtttaaacaagatccttaacattaatgaagacacagagacatctgttcaaaatattatttcctcaaatttggaaaggacagtacaattgatttctgaagactggagcctagaaaaaagtacgcataatctactctctttattcatgatgctccagaatgcaaatgtcacaggtagcagtttagaagcattatcaagttttattgaaaaaagtgaaacaccttacaactttgaagaactatggcccaagtttcaacaaatcatgaaagacctaacccaagattttagaatcagacacctgctttctgaaatgaacaaaggaatcaaaagtataaattcaatggctcttcaaaagataactttgcagtttgcccatttcctggaaatcctggattcaccgtcattgaagacattagaaattattgaagattttctattggtcacaaaaaactggcttcaggaatatgcaaatgaggattactccagaatgatagaaacattattcattcctgtgaccaatgagagttcaactgaagatatagctttgttagccaaagctattgctactttttggggctctttaaaaaatatatctagagcaggcaattttgatgttgcctttcttacccatctgctaaatcaagaacagctgactaatttctcagttgttcagctgctttttgaaaacatcctaattaatttgatcaataacttagctgggaattctcaggaagcagcttggaacttaaatgatactgaccttcaaataatgaatttcattaaccttatcttgaaccatatgcagtcagaaactagtaggaaaacagttctctctctgagaagcatagtagatttcacagaacagtttttgaaaacattcttctccctttttctaaaggaagattctgagaacaaaatatctcttctgctgaaatatttccacaaagatgttattgcagagatgagttttgtcccaaaagataaaattctagaaattctgaaactggatcaatttcttaccctgatgatacaagacagattgatgaacattttttcaagtttaaaggagactatatatcacctaatgaaaagttcatttatattagacaatggagaattttattttgatactcatcaaggactgaagttcatgcaagatttatttaatgcccttctcagggaaacttcaatgaaaaataagactgaaaataatatagactttttcacagtggtgagtcagttgtttttccatgtgaataagtctgaggacctcttcaaactcaatcaagatcttgggtcagctcttcaccttgtaagagaatgttcaacagagatggcaagacttctggatacaattttacactctcctaataaggacttctatgctttgtatcctaccctccaagaagttatacttgctaatctaacggatttgcttttctttataaataattcattccctctaagaaacagagcaacattagaaattactaagagattagttggtgctatttcaagagcaagtgaagaaagtcacgtcctgaaacccctcttagaaatgtctgggactctggtcatgctgttgaatgacagtgctgacctgagagatcttgccacatcaatggactccattgtgaaacttcttaagctggtcaagaaagtttcggggaagatgtccacagtttttaaaactcattttatctccaataccaaggacagtgtgaaattctttgacactctgtattccatcatgcaacaaagtgttcaaaatcttgtgaaagaaatagctactttaaaaaaaatagatcatttcacatttgaaaagataaatgatttgttggtgccatttcttgacttggcctttgaaatgattggggtagaaccttatatatcatcaaactctgatattttcagtatgtcacctagcatactctcatatatgaaccaatctaaggacttttctgatattttggaagaaattgctgaatttttaacatctgtgaaaatgaacttggaagatatgaggagtcttgcggtagcatttaacaatgagactcaaacattttctatggattctgtcaacttacgggaagaaattctgggttgcttagttcctataaataacatcaccaaccaaatggacttcttataccctaatccaatttccactcatagtggccctcaagatataaaatgggaaataattcatgaagtgatcccttttttggataaaatattatcacaaaacagcacagaaataggatctttcttgaaaatggtgatctgtctcaccttagaagctctttggaaaaacttaaagaaagataattggaatgtttctaatgtgttgatgacatttactcagcatccaaataaccttttgaaaaccatagaaacagttttagaggcctccagtggaattaaaagtgactatgaaggtgatttgaataaaagtttatattttgacacacctttgagtcagaatataactcatcatcaacttgaaaaagcaatccataatgttttaagtagaatagctctctggaggaaaggacttctgtttaacaactctgaatggataacttccacaagaactttgtttcagccactttttgagattttcattaaagcaaccaccggaaagaatgtcacatcagaaaaagaagagagaaccaagaaagagatgattgactttccttatagtttcaaaccatttttctgtttggagaaatacctgggaggattatttgtattgactaaatactggcaacaaatcccactaacagatcaaagtgttgttgagatttgtgaagttttccagcagactgtgaagccctcagaagccatggagatgctgcagaaagtgaagatgatggtcgtacgtgtgctcaccatcgttgcagaaaacccttcctggaccaaggacattttgtgtgctactctgagttgcaagcaaaatgggataaggcatctcattttatctgctatacaaggggtcactttggcgcaggaccacttccaggaaattgaaaagatatggtcctcgccgaatcagctaaattgtgaaagtcttagcaagaatctttctagcaccttggagagcttcaagagcagcttggaaaatgccactggccaggactgcacaagccagccgaggctggagacggtgcagcagcacttgtacatgttggccaaaagcctcgaggaaacttggtcatcagggaatcccatcatgacttttctcagcaatttcacagtaactgaggatgtaaaaataaaagatttgatgaagaatatcaccaagttgactgaggagcttcgctcttccatccaaatctcgaatgagactatccatagcattctagaagcaaatatttcccactccaaggttctcttcagtgccctcaccgtagctctgtctggaaagtgtgatcaggaaatccttcatctcctgctgacatttcccaaaggggaaaaatcttggatcgcagcggaggaactctgtagcctgccagggtcaaaagtgtattctctgattgtgttgctgagtcgaaacttggatgtgcgagctttcatttacaagactctgatgccttctgaagcaaatggcttgctcaactccttgctggatatagtttccagcctcagcgccttgcttgccaaagcccagcacgtctttgagtatcttcctgagtttcttcacacatttaaaatcactgccttgctagaaaccctggactttcaacaggtttcacaaaatgtccaggccagaagttcagcttttggttctttccagtttgtgatgaagatggtttgcaaggaccaagcatcattccttagcgattctaatatgtttattaatttgcccagagttaaggaactcttggaagatgacaaagaaaaattcaacattcctgaagattcaacaccgttttgcttgaagctttatcaggaaattctacaattgccaaatggtgctttggtgtggaccttcctaaaacccatattgcatggaaaaatactatacacaccaaacactccagaaattaacaaggtcattcaaaaggctaattacaccttttatattgtggacaaactaaaaactttatcagaaacactgctggaaatgtccagccttttccagagaagtggaagtggccagatgttcaaccagctgcaggaggccctgagaaacaaatttgtaagaaactttgtagaaaaccagttgcacattgatgtagacaaacttactgaaaaactccagacatacggagggctgctggatgagatgtttaaccatgcaggcgctggacgcttccgtttcttgggcagcatcttggtcaatctctcttcctgcgtggcactgaaccgtttccaggctctgcagtctgtcgacatcctggagactaaagcacatgaactcttgcagcagaacagcttcttggccagtatcattttcagcaattccttattcgacaagaacttcagatcagagtctgtcaaactgccaccccatgtctcatacacaatccggaccaatgtgttatacagcgtgcgaacagatgtggtaaaaaacccttcttggaagttccaccctcagaatctaccagctgatgggttcaaatataactacgtctttgccccactgcaagacatgatcgaaagagccatcattttggtgcagactgggcaggaagccctggaaccagcagcacagactcaggcggccccttacccctgccataccagcgacctattcctgaacaacgttggtttcttttttccactgataatgatgctgacgtggatggtgtctgtggccagcatggtcagaaagttggtgtatgagcaggagatacagatagaagagtatatgcggatgatgggagtgcatccagtgatccatttcctggcctggttcctggagaacatggctgtgttgaccataagcagtgctactctggccatcgttctgaaaacaagtggcatctttgcacacagcaatacctttattgttttcctctttctcttggattttgggatgtcagtcgtcatgctgagctacctcttgagtgcatttttcagccaagctaatacagcggccctttgtaccagcctggtgtacatgatcagctttctgccctacatagttctattggttctacataaccaattaagttttgttaatcagacatttctgtgccttctttcgacaaccgcctttggacaaggggtattttttattacattcctggaaggacaagagacagggattcaatggaataatatgtaccaggctctggaacaagggggcatgacatttggctgggtttgctggatgattctttttgattcaagcctttattttttgtgtggatggtacttgagcaacttgattcctggaacatttggtttacggaaaccatggtatttcccctttactgcctcatattggaagagtgtgggtttcttggtggagaaaaggcaatactttctaagttctagtctgttcttcttcaatgagaactttgacaataaagggtcatcactgcaaaacagggaaggagagcttgaaggaagtgccccgggagtcaccctggtgtctgtgaccaaggaatatgagggccacaaggctgtggtccaagacctcagcctgaccttctacagagaccaaatcaccgccctgctggggacaaacggtgccgggaaaaccactatcatatccatgttgacggggctccaccctcccacttctggaaccatcatcatcaatggcaagaacctacagacagacctgtcgagggtcagaatggagcttggtgtgtgtccgcagcaggacatcctgttggacaacctcaccgtccgggaacatttgctgctctttgcttccataaaggcgcctcagtggaccaagaaggagctgcatcagcaagtcaatcaaactcttcaggatgtggacttaactcagcatcagcacaaacagacccgagctctgtctggaggcctgaagaggaagctctcccttggcattgctttcatgggcatgtcgaggaccgtggttctggatgagcccaccagtggggtggacccttgctcccggcatagcctgtgggacattctgctcaagtaccgagaaggtcgtacgatcatcttcacaacccaccacctggatgaagctgaagcgctgagtgaccgcgtggccgtcctccagcatgggaggctcaggtgctgcggtcctcccttctgcctgaaggaggcatatggccaggggctccgcctgacactcacgaggcagccttctgttctggaggcccatgatctgaaagacatggcttgtgttacatccctgataaagatctatattccacaagcatttctcaaagacagcagtggaagtgagctgacctacaccattccaaaggacacagacaaggcctgcttgaaagggctcttccaggccctggatgagaacctgcatcagctgcacctgacgggctatgggatctcagacaccaccttagaagaggtgtttttgatgcttttgcaagattccaacaagaaatctcacattgccctggggactgagtcagagctgcagaaccacaggcctacaggacatctgtctggctactgtggctccctagcacggcccgcaactgtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcagcagtgggggcgacaacttggacctcacccgtgtgcttctgcggaagtttagagatcaagatttgccctgtgcagatttaaacccacgccagaagaattcttcatgctggcgcacagatcccttttctcacccagaattccaggattcatgtggctgcctgaagtgtccaaatagaagtgctagtgctccctacctgaccaaccacctgggccacacactgttgaatctctcaggcttcaatatggaggagtacttgctggcaccatctgaaaaaccaaggcttggaggttggtcttttggattaaaaatccccagtgaagctggaggtgcaaatggaaacatatcaaaacccccaactctggcaaaggtgtggtataatcagaagggttttcattccctaccttcctacttaaatcatctaaacaaccttattttgtggcagcacctaccccctactgtggactggagacaatacggaataacactctacagccacccatatggaggggccttgctgaacgaggacaagatcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagagtgctttggacttctaggggtgaatggagctgggaagagcacgactttcaaaatgctgaatggtgaagtttctctaacttcaggacatgctatcatcaggactcccatgggagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggttgctggagacctcatcaggcgcttacacctcgaagcccacgcggacaaacctgtggccacctacagtgggggaaccaagcggaaactctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacagcatggaggagtgtgaggctctttgcacaagactggccataatggttaacggcagcttcaaatgtcttggttctcctcagcacatcaaaaataggtttggtgatggttatacagtcaaagtttggctctgtaaggaagcaaatcaacattgcactgtttctgaccacttgaagctttattttccaggaattcagttcaagggacagcacctgaatttattagaatatcatgtgccaaaaagatggggatgcctagctgacttgttcaaagttatagagaacaataaaaccttcttgaatattaagcattattccattaaccaaaccactttggagcaggtatttattaattttgcttctgagcagcagcaaactctacaatctactcttgatccatccactgacagtcaccacacacatcacttgcccatctga

SEQ ID NO: 12 - protein, 5058 aa, Homo sapiens
MGHAGCQFKALLWKNWLCRLRNPVLFLAEFFWPCILFVILTVLRFQEPPRYRDICYLQPRDLPSCGVIPFVQSLLCNTGSRCRNFSYEGSMEHHFRLSRFQTAADPKKVNNLAFLKEIQDLAEEIHGMMDKAKNLKRLWVERSNTPDSSYGSSFFTMDLNKTEEVILKLESLHQQPHIWDFLLLLPRLHTSHDHVEDGMDVAVNLLQTILNSLISLEDLDWLPLNQTFSQVSELVLNVTISTLTFLQQHGVAVTEPVYHLSMQNIVWDPQKVQYDLKSQFGFDDLHTEQILNSSAELKEIPTDTSLEKMVCSVLSSTSEDEAEKWGHVGGCHPKWSEAKNYLVHAVSWLRVYQQVFVQWQQGSLLQKTLTGMGHSLEALRNQFEEESKPWKVVEALHTALLLLNDSLSADGPKDNHTFPKILQHLWKLQSLLQNLPQWPALKRFLQLDGALRNAIAQNLHFVQEVLICLETSANDFKWFELNQLKLEKDVFFWELKQMLAKNAVCPNGRFSEKEVFLPPGNSSIWGGLQGLLCYCNSSETSVLNKLLGSVEDADRILQEVITWHKNMSVLIPEEYLDWQELEMQLSEASLSCTRLFLLLGADPSPENDVFSSDCKHQLVSTVIFHTLEKTQFFLEQAYYWKAFKKFIRKTCEVAQYVNMQESFQNRLLAFPEESPCFEENMDWKMISDNYFQFLNNLLKSPTASISRALNFTKHLLMMEKKLHTLEDEQMNFLLSFVEFFEKLLLPNLFDSSIVPSFHSLPSLTEDILNISSLWTNHLKSLKRDPSATDAQKLLEFGNEVIWKMQTLGSHWIRKEPKNLLRFIELILFEINPKLLELWAYGISKGKRAKLENFFTLLNFSVPENEILSTSFNFSQLFHSDWPKSPAMNIDFVRLSEAIITSLHEFGFLEQEQISEALNTVYAIRNASDLFSALSEPQKQEVDKILTHIHLNVFQDKDSALLLQIYSSFYRYIYELLNIQSRGSSLTFLTQISKHILDIIKQFNFQNISKAFAFLFKTAEVLGGISNVSYCQQLLSIFNFLELQAQSFMSTEGQELEVIHTTLTGLKQLLIIDEDFRISLFQYMSQFFNSSVEDLLDNKCLISDNKHISSVNYSTSEESSFVFPLAQIFSNLSANVSVFNKFMSIHCTVSWLQMWTEIWETISQLFKFDMNVFTSLHHGFTQLLDELEDDVKVSKSCQGILPTHNVARLILNLFKNVTQANDFHNWEDFLDLRDFLVALGNALVSVKKLNLEQVEKSLFTMEAALHQLKTFPFNESTSREFLNSLLEVFIEFSSTSEYIVRNLDSINDFLSNNLTNYGEKFENIITELREAIVFLRNVSHDRDLFSCADIFQNVTECILEDGFLYVNTSQRMLRILDTLNSTFSSENTISSLKGCIVWLDVINHLYLLSNSSFSQGHLQNILGNFRDIENKMNSILKIVTWVLNIKKPLCSSNGSHINCVNIYLKDVTDFLNIVLTTVFEKEKKPKFEILLALLNDSTKQVRMSINNLTTDFDFASQSNWRYFTELILRPIEMSDEIPNQFQNIWLHLITLGKEFQKLVKGIYFNILENNSSSKTENLLNIFATSPKEKDVNSVGNSIYHLASYLAFSLSHDLQNSPKIIISPEIMKATGLGIQLIRDVFNSLMPVVHHTSPQNAGYMQALKKVTSVMRTLKKADIDLLVDQLEQVSVNLMDFFKNISSVGTGNLVVNLLVGLMEKFADSSHSWNVNHLLQLSRLFPKDVVDAVIDVYYVLPHAVRLLQGVPGKNITEGLKDVYSFTLLHGITISNITKEDFAIVIKILLDTIELVSDKPDIISEALACFPVVWCWNHTNSGFRQNSKIDPCNVHGLMSSSFYGKVASILDHFHLSPQGEDSPCSNESSRMEITRKVVCIIHELVDWNSILLELSEVFHVNISLVKTVQKFWHKILPFVPPSINQTRDSISELCPSGSIKQVALQIIEKLKNVNFTKVTSGENILDKLSSLNKILNINEDTETSVQNIISSNLERTVQLISEDWSLEKSTHNLLSLFMMLQNANVTGSSLEALSSFIEKSETPYNFEELWPKFQQIMKDLTQDFRIRHLLSEMNKGIKSINSMALQKITLQFAHFLEILDSPSLKTLEIIEDFLLVTKNWLQEYANEDYSRMIETLFIPVTNESSTEDIALLAKAIATFWGSLKNISRAGNFDVAFLTHLLNQEQLTNFSVVQLLFENILINLINNLAGNSQEAAWNLNDTDLQIMNFINLILNHMQSETSRKTVLSLRSIVDFTEQFLKTFFSLFLKEDSENKISLLLKYFHKDVIAEMSFVPKDKILEILKLDQFLTLMIQDRLMNIFSSLKETIYHLMKSSFILDNGEFYFDTHQGLKFMQDLFNALLRETSMKNKTENNIDFFTVVSQLFFHVNKSEDLFKLNQDLGSALHLVRECSTEMARLLDTILHSPNKDFYALYPTLQEVILANLTDLLFFINNSFPLRNRATLEITKRLVGAISRASEESHVLKPLLEMSGTLVMLLNDSADLRDLATSMDSIVKLLKLVKKVSGKMSTVFKTHFISNTKDSVKFFDTLYSIMQQSVQNLVKEIATLKKIDHFTFEKINDLLVPFLDLAFEMIGVEPYISSNSDIFSMSPSILSYMNQSKDFSDILEEIAEFLTSVKMNLEDMRSLAVAFNNETQTFSMDSVNLREEILGCLVPINNITNQMDFLYPNPISTHSGPQDIKWEIIHEVIPFLDKILSQNSTEIGSFLKMVICLTLEALWKNLKKDNWNVSNVLMTFTQHPNNLLKTIETVLEASSGIKSDYEGDLNKSLYFDTPLSQNITHHQLEKAIHNVLSRIALWRKGLLFNNSEWITSTRTLFQPLFEIFIKATTGKNVTSEKEERTKKEMIDFPYSFKPFFCLEKYLGGLFVLTKYWQQIPLTDQSVVEICEVFQQTVKPSEAMEMLQKVKMMVVRVLTIVAENPSWTKDILCATLSCKQNGIRHLILSAIQGVTLAQDHFQEIEKIWSSPNQLNCESLSKNLSSTLESFKSSLENATGQDCTSQPRLETVQQHLYMLAKSLEETWSSGNPIMTFLSNFTVTEDVKIKDLMKNITKLTEELRSSIQISNETIHSILEANISHSKVLFSALTVALSGKCDQEILHLLLTFPKGEKSWIAAEELCSLPGSKVYSLIVLLSRNLDVRAFIYKTLMPSEANGLLNSLLDIVSSLSALLAKAQHVFEYLPEFLHTFKITALLETLDFQQVSQNVQARSSAFGSFQFVMKMVCKDQASFLSDSNMFINLPRVKELLEDDKEKFNIPEDSTPFCLKLYQEILQLPNGALVWTFLKPILHGKILYTPNTPEINKVIQKANYTFYIVDKLKTLSETLLEMSSLFQRSGSGQMFNQLQEALRNKFVRNFVENQLHIDVDKLTEKLQTYGGLLDEMFNHAGAGRFRFLGSILVNLSSCVALNRFQALQSVDILETKAHELLQQNSFLASIIFSNSLFDKNFRSESVKLPPHVSYTIRTNVLYSVRTDVVKNPSWKFHPQNLPADGFKYNYVFAPLQDMIERAIILVQTGQEALEPAAQTQAAPYPCHTSDLFLNNVGFFFPLIMMLTWMVSVASMVRKLVYEQEIQIEEYMRMMGVHPVIHFLAWFLENMAVLTISSATLAIVLKTSGIFAHSNTFIVFLFLLDFGMSVVMLSYLLSAFFSQANTAALCTSLVYMISFLPYIVLLVLHNQLSFVNQTFLCLLSTTAFGQGVFFITFLEGQETGIQWNNMYQALEQGGMTFGWVCWMILFDSSLYFLCGWYLSNLIPGTFGLRKPWYFPFTASYWKSVGFLVEKRQYFLSSSLFFFNENFDNKGSSLQNREGELEGSAPGVTLVSVTKEYEGHKAVVQDLSLTFYRDQITALLGTNGAGKTTIISMLTGLHPPTSGTIIINGKNLQTDLSRVRMELGVCPQQDILLDNLTVREHLLLFASIKAPQWTKKELHQQVNQTLQDVDLTQHQHKQTRALSGGLKRKLSLGIAFMGMSRTVVLDEPTSGVDPCSRHSLWDILLKYREGRTIIFTTHHLDEAEALSDRVAVLQHGRLRCCGPPFCLKEAYGQGLRLTLTRQPSVLEAHDLKDMACVTSLIKIYIPQAFLKDSSGSELTYTIPKDTDKACLKGLFQALDENLHQLHLTGYGISDTTLEEVFLMLLQDSNKKSHIALGTESELQNHRPTGHLSGYCGSLARPATVQGVQLLRAQVAAILARRLRRTLRAGKSTLADLLLPVLFVALAMGLFMVRPLATEYPPLRLTPGHYQRAETYFFSSGGDNLDLTRVLLRKFRDQDLPCADLNPRQKNSSCWRTDPFSHPEFQDSCGCLKCPNRSASAPYLTNHLGHTLLNLSGFNMEEYLLAPSEKPRLGGWSFGLKIPSEAGGANGNISKPPTLAKVWYNQKGFHSLPSYLNHLNNLILWQHLPPTVDWRQYGITLYSHPYGGALLNEDKILESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWIFVQLASQGTVLLLLRVLLHWDLLRWPRGHSTLQGTVKSSKDTDVEKEEKRVFEGRTNGDILVLYNLSKHYRRFFQNIIAVQDISLGIPKGECFGLLGVNGAGKSTTFKMLNGEVSLTSGHAIIRTPMGDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHSMEECEALCTRLAIMVNGSFKCLGSPQHIKNRFGDGYTVKVWLCKEANQHCTVSDHLKLYFPGIQFKGQHLNLLEYHVPKRWGCLADLFKVIENNKTFLNIKHYSINQTTLEQVFINFASEQQQTLQSTLDPSTDSHHTHHLPI

SEQ ID NO: 13 - DNA, 2073 bp, Homo sapiens
atgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatag

SEQ ID NO: 14 - protein, 690 aa, Homo sapiens
MKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEKKKKKKDKEKKKKEEKSKDKKEEEKKEVVVIDPSGNTYYNWLFCITLPVMYNWTMVIARACFDELQSDYLEYWLILDYVSDIVYLIDMFVRTRTGYLEQGLLVKEELKLINKYKSNLQFKLDVLSLIPTDLLYFKLGWNYPEIRLNRLLRFSRMFEFFQRTETRTNYPNIFRISNLVMYIVIIIHWNACVFYSISKAIGFGNDTWVYPDINDPEFGRLARKYVYSLYWSTLTLTTIGETPPPVRDSEYVFVVVDFLIGVLIFATIVGNIGSMISNMNAARAEFQARIDAIKQYMHFRNVSKDMEKRVIKWFDYLWTNKKTVDEKEVLKYLPDKLRAEIAINVHLDTLKKVRIFADCEAGLLVELVLKLQPQVYSPGDYICKKGDIGREMYIIKEGKLAVVADDGVTQFVVLSDGSYFGEISILNIKGSKAGNRRTANIKSIGYSDLFCLSKDDLMEALTEYPDAKTMLEEKGKQILMKDGLLDLNIANAGSDPKDLEEKVTRMEGSVDLLQTRFARILAEYESMQQKLKQRLTKVEKFLKPLIDTEFSSIEGPGAESGPIDST

SEQ ID NO: 15 - DNA, 1995 bp, Homo sapiens
atgaccgaaaaaaccaatggtgtgaagagctccccagccaataatcacaaccatcatgcacctcctgccatcaaggccaatggcaaagatgaccacaggacaagcagcaggccacactctgcagctgacgatgacacctcctcagaactgcagaggctggcagacgtggatgccccacagcagggaaggagtggcttccgcaggatagttcgcctggtggggatcatcagagaatgggccaacaagaatttccgagaggaggaacctaggcctgactcattcctcgagcgttttcgtgggcctgaactccagactgtgaccacacaggagggggatggcaaaggcgacaaggatggcgaggacaaaggcaccaagaagaaatttgaactatttgtcttggacccagctggggattggtactactgctggctatttgtcattgccatgcccgtcctttacaactggtgcctgctggtggccagagcctgcttcagtgacctacagaaaggctactacctggtgtggctggtgctggattatgtctcagatgtggtctacattgcggacctcttcatccgattgcgcacaggtttcctggagcaggggctgctggtcaaagataccaagaaactgcgagacaactacatccacaccctgcagttcaagctggatgtggcttccatcatccccactgacctgatctattttgctgtggacatccacagccctgaggtgcgcttcaaccgcctgctgcactttgcccgcatgtttgagttctttgaccggacagagacacgcaccaactaccctaacatcttccgcatcagcaaccttgtcctctacatcttggtcatcatccactggaatgcctgcatctattatgccatctccaaatccataggctttggggtcgacacctgggtttacccaaacatcactgaccctgagtatggctacctggctagggaatacatctattgcctttactggtccacactgactctcactaccattggggagacaccaccccctgtaaaggatgaggagtacctatttgtcatctttgacttcctgattggcgtcctcatctttgccaccatcgtgggaaatgtgggctccatgatctccaacatgaatgccacccgggcagagttccaggctaagatcgatgccgtgaaacactacatgcagttccgaaaggtcagcaaggggatggaagccaaggtcattaggtggtttgactacttgtggaccaataagaagacagtggatgagcgagaaattctcaagaatctgccagccaagctcagggctgagatagccatcaatgtccacttgtccacactcaagaaagtgcgcatcttccatgattgtgaggctggcctgctggtagagctggtactgaaactccgtcctcaggtcttcagtcctggggattacatttgccgcaaaggggacatcggcaaggagatgtacatcattaaggagggcaaactggcagtggtggctgatgatggtgtgactcagtatgctctgctgtcggctggaagctgctttggcgagatcagtatccttaacattaagggcagtaaaatgggcaatcgacgcacagctaatatccgcagcctgggctactcagatctcttctgcttgtccaaggatgatcttatggaagctgtgactgagtaccctgatgccaagaaagtcctagaagagaggggtcgggagatcctcatgaaggagggactgctggatgagaacgaagtggcaaccagcatggaggtcgacgtgcaggagaagctagggcagctggagaccaacatggaaaccttgtacactcgctttggccgcctgctggctgagtacacgggggcccagcagaagctcaagcagcgcatcacagttctggaaaccaagatgaaacagaacaatgaagatgactacctgtctgatgggatgaacagccctgagctggctgctgctgacgagccataa

SEQ ID NO: 16 - protein, 664 aa, Homo sapiens
MTEKTNGVKSSPANNHNHHAPPAIKANGKDDHRTSSRPHSAADDDTSSELQRLADVDAPQQGRSGFRRIVRLVGIIREWANKNFREEEPRPDSFLERFRGPELQTVTTQEGDGKGDKDGEDKGTKKKFELFVLDPAGDWYYCWLFVIAMPVLYNWCLLVARACFSDLQKGYYLVWLVLDYVSDVVYIADLFIRLRTGFLEQGLLVKDTKKLRDNYIHTLQFKLDVASIIPTDLIYFAVDIHSPEVRFNRLLHFARMFEFFDRTETRTNYPNIFRISNLVLYILVIIHWNACIYYAISKSIGFGVDTWVYPNITDPEYGYLAREYIYCLYWSTLTLTTIGETPPPVKDEEYLFVIFDFLIGVLIFATIVGNVGSMISNMNATRAEFQAKIDAVKHYMQFRKVSKGMEAKVIRWFDYLWTNKKTVDEREILKNLPAKLRAEIAINVHLSTLKKVRIFHDCEAGLLVELVLKLRPQVFSPGDYICRKGDIGKEMYIIKEGKLAVVADDGVTQYALLSAGSCFGEISILNIKGSKMGNRRTANIRSLGYSDLFCLSKDDLMEAVTEYPDAKKVLEERGREILMKEGLLDENEVATSMEVDVQEKLGQLETNMETLYTRFGRLLAEYTGAQQKLKQRITVLETKMKQNNEDDYLSDGMNSPELAAADEP

SEQ ID NO: 17 - DNA, 2085 bp, Homo sapiens
atggccaagatcaacacccaatactcccacccctccaggacccacctcaaggtaaagacctcagaccgagatctcaatcgcgctgaaaatggcctcagcagagcccactcgtcaagtgaggagacatcgtcagtgctgcagccggggatcgccatggagaccagaggactggctgactccgggcagggctccttcaccggccaggggatcgccaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaagcgcctggcccctggccaaatgcaacactaacaccagcaacaacacggaggaggagaagaagacgaaaaagaaggatgcgatcgtggtggacccgtccagcaacctgtactaccgctggctgaccgccatcgccctgcctgtcttctataactggtatctgcttatttgcagggcctgtttcgatgagctgcagtccgagtacctgatgctgtggctggtcctggactactcggcagatgtcctgtatgtcttggatgtgcttgtacgagctcggacaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtga

SEQ ID NO: 18 - protein, 694 aa, Homo sapiens
MAKINTQYSHPSRTHLKVKTSDRDLNRAENGLSRAHSSSEETSSVLQPGIAMETRGLADSGQGSFTGQGIARLSRLIFLLRRWAARHVHHQDQGPDSFPDRFRGAELKEVSSQESNAQANVGSQEPADRGRSAWPLAKCNTNTSNNTEEEKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 19 - DNA, 1728 bp, Homo sapiens
atgagccaggacaccaaagtgaagacaacagagtccagtcccccagccccatccaaggccaggaagttgctgcctgtcctggacccatctggggattactactactggtggctgaacacaatggtcttcccagtcatgtataacctcatcatcctcgtgtgcagagcctgcttccccgacttgcagcacggttatctggtggcctggttggtgctggactacacgagtgacctgctatacctactagacatggtggtgcgcttccacacaggattcttggaacagggcatcctggtggtggacaagggtaggatctcgagtcgctacgttcgcacctggagtttcttcttggacctggcttccctgatgcccacagatgtggtctacgtgcggctgggcccgcacacacccaccctgaggctgaaccgctttctccgcgcgccccgcctcttcgaggccttcgaccgcacagagacccgcacagcttacccaaatgcctttcgcattgccaagctgatgctttacatttttgtcgtcatccattggaacagctgcctatactttgccctatcccggtacctgggcttcgggcgtgacgcatgggtgtacccggaccccgcgcagcctggctttgagcgcctgcggcgccagtacctctatagcttttacttctccacgctgatactgactacagtgggcgatacaccgccgccagccagggaagaagagtacctcttcatggtgggcgacttcctgctggccgtcatgggtttcgccaccatcatgggtagcatgagctctgtcatctacaacatgaacactgcagatgcggctttctacccagatcatgcactggtgaagaagtacatgaagctgcagcacgtcaaccgcaagctggagcggcgagttattgactggtatcagcacctgcagatcaacaagaagatgaccaacgaggtagccatcttacagcacttgcctgagcggctgcgggcagaagtggctgtgtctgtgcacctgtccactctgagccgggtgcagatctttcagaactgtgaggccagcctgctggaggagctggtgctgaagctgcagccccagacctactcaccaggtgaatatgtatgccgcaaaggagacattggccaagagatgtacatcatccgagagggtcaactggccgtggtggcagatgatggtatcacacagtatgctgtgctcggtgcagggctctactttggggagatcagcatcatcaacatcaaagggaacatgtctgggaaccgccgcacagccaacatcaagagcctaggttattcagacctattctgcctgagcaaggaggacctgcgggaggtgctgagcgagtatccacaagcacagaccatcatggaggagaaaggacgtgagatcctgctgaaaatgaacaagttggacgtgaatgctgaggcagctgagatcgccctgcaggaggccacagagtcccggctacgaggcctagaccagcagctggatgatctacagaccaagtttgctcgcctcctggctgagctggagtccagcgcacttaagattgcttaccgcattgaacggctggagtggcagactcgagagtggccaatgcccgaggacctggctgaggctgatgacgagggtgagcctgaggagggaacttccaaagatgaagagggcagggccagccaggagggacccccaggtccagagtga

SEQ ID NO: 20 - protein, 575 aa, Homo sapiens
MSQDTKVKTTESSPPAPSKARKLLPVLDPSGDYYYWWLNTMVFPVMYNLIILVCRACFPDLQHGYLVAWLVLDYTSDLLYLLDMVVRFHTGFLEQGILVVDKGRISSRYVRTWSFFLDLASLMPTDVVYVRLGPHTPTLRLNRFLRAPRLFEAFDRTETRTAYPNAFRIAKLMLYIFVVIHWNSCLYFALSRYLGFGRDAWVYPDPAQPGFERLRRQYLYSFYFSTLILTTVGDTPPPAREEEYLFMVGDFLLAVMGFATIMGSMSSVIYNMNTADAAFYPDHALVKKYMKLQHVNRKLERRVIDWYQHLQINKKMTNEVAILQHLPERLRAEVAVSVHLSTLSRVQIFQNCEASLLEELVLKLQPQTYSPGEYVCRKGDIGQEMYIIREGQLAVVADDGITQYAVLGAGLYFGEISIINIKGNMSGNRRTANIKSLGYSDLFCLSKEDLREVLSEYPQAQTIMEEKGREILLKMNKLDVNAEAAEIALQEATESRLRGLDQQLDDLQTKFARLLAELESSALKIAYRIERLEWQTREWPMPEDLAEADDEGEPEEGTSKDEEGRASQEGPPGPE

SEQ ID NO: 21 - DNA, 3756 bp, Homo sapiens
atgttgggctgggtccagagggtgctgcctcagcccccagggacccctcggaagaccaagatgcaggaggaagaggaagtggaaccagagccagagatggaggcggaggtggaaccagaaccgaatcctgaggaggccgagacagagtccgagtccatgccccccgaagagtcattcaaggaggaggaagtggctgtggcagacccaagccctcaggagaccaaggaggctgcccttacttccaccatatccctccgggcccagggcgctgagatttctgaaatgaatagtcccagccgcagggtactgacctggctcatgaagggcgtagagaaggtgatcccgcagcctgttcacagcatcacggaggacccggctcagatcctggggcatggcagcactggggacacagggtgcacagatgaacccaatgaggcccttgaggcccaagacactaggcctgggctgcggctgcttctgtggctggagcagaatctggaaagagtgcttcctcagccccccaaatcctctgaggtctggagagatgagcctgcagttgctacaggtgctgcctcagacccagcgcctccaggacgcccccaggaaatggggcccaagctgcaggcccgggagaccccctccctgcccacacccatccccctgcagcccaaggaggaacccaaggaggcaccagctccagagccccagcccggctcccaggcccagacctcctccctgccaccaaccagggaccctgccaggctggtggcatgggtcctgcacaggctggagatggccttgccgcagccagtgctacatgggaaaataggggaacaggagcctgactcccctgggatatgtgatgtgcagaccatcagcatccttcctggaggacaagtggagcctgaccttgtcctagaggaggttgaaccgccctgggaggatgcccaccaggatgtcagtaccagcccacagggtacagaggtggttccagcttatgaagaagagaacaaagctgtggagaagatgcccagagagctgtcccggattgaagaggagaaagaagatgaggaggaggaagaggaagaggaggaggaggaggaagaggaggaggtgactgaggtgctgctggatagctgtgtggtgtcgcaggtgggcgtgggccagagtgaagaagacgggacccggccccagagcacttcagatcagaagctgtgggaggaagttggggaggaggccaagaaggaggctgaagagaaggccaaggaggaggccgaggaggtggctgaagaggaggctgaaaaggagccccaggactgggcggagaccaaggaggagcctgaggctgaggccgaggctgccagttcaggagtgcctgccacgaaacagcacccagaagtgcaggtggaagatactgatgctgatagctgccccctcatggcagaagagaatccaccctcaaccgtgttgccgccaccgtctcctgccaaatcagacacccttatagtcccaagctcagcctcggggacacacaggaagaagctgccctctgaggatgatgaggctgaagagctcaaggcgttgtcaccagcagagtccccagtggttgcctggtctgaccccaccaccccgaaggacactgatggccaggaccgtgcggcctccacggccagcacaaatagcgccatcatcaacgaccggctccaggagctggtgaagctcttcaaggagcggacagagaaagtgaaggagaaactcattgaccctgacgtcacctctgatgaggagagccccaagccctccccagccaagaaagccccagagccagctccagacacaaagcccgctgaagccgagccagtggaagaggagcactattgcgacatgctctgctgcaagttcaaacaccgcccctggaagaagtaccagtttccccagagcattgacccgctgaccaacctgatgtatgtcctatggctgttcttcgtggtgatggcctggaattggaactgttggctgattcccgtgcgctgggccttcccctaccagaccccggacaacatccaccactggctgctgatggattacctatgcgacctcatctacttcctggacatcaccgtgttccagacacgcctgcagtttgtcagaggcggggacatcattacggacaaaaaggacatgcgaaataactacctgaagtctcgccgcttcaagatggacctgctcagcctcctgcccttggattttctctatttgaaagtcggtgtgaaccccctcctccgcctgccccgctgtttaaagtacatggccttcttcgagtttaacagccgcctggaatccatcctcagcaaagcctacgtgtacagggtcatcaggaccacagcctaccttctctacagcctgcatttgaattcctgtctttattactgggcatcggcctatcagggcctcggctccactcactgggtttacgatggcgtgggaaacagttatattcgctgttactactttgctgtgaagaccctcatcaccatcggggggctgcctgaccccaagacactctttgaaattgtcttccagctgctgaattatttcacgggcgtctttgctttctctgtgatgatcggacagatgagagatgtggtaggggccgccaccgccggacagacctactaccgcagctgcatggacagcacggtgaagtacatgaatttctacaagatccccaagtccgtgcagaaccgcgtcaagacctggtacgagtacacctggcactcgcaaggcatgctggatgagtcagagctgatggtgcagcttccagacaagatgcggctggacctcgccatcgacgtgaactacaacatcgttagcaaagtcgcactctttcagggctgtgaccggcagatgatctttgacatgctgaagaggcttcgctctgttgtctacctgcccaacgactatgtgtgcaagaagggggagatcggccgtgagatgtacatcatccaggcagggcaagtgcaggtcttgggcggccctgatgggaaatctgtgctggtgacgctgaaagctggatctgtgtttggagaaataagcttgctggctgttgggggcgggaaccggcgcacggccaacgtggtggcgcacgggtttaccaacctcttcatcctggataagaaggacctgaatgagattttggtgcattatcctgagtctcagaagttactccggaagaaagccaggcgcatgctgagaagcaacaataagcccaaggaggagaagagcgtgctgatccttccaccccgggcgggcaccccaaagctcttcaacgctgccctcgctatgacaggaaagatgggtggcaagggggcaaaaggcggcaaacttgctcacctccgggcccggctcaaagaactggccgcgctggaggcggctgcaaagcagcaagagttggtggaacaggccaagagctcgcaagacgtcaagggagaggaaggctccgccgccccagaccagcacacgcacccaaaggaggccgccaccgacccacccgcgccccggacgccccccgagcccccggggtctccaccgagctctccaccgcctgcctcccttgggaggccggagggagaggaggaggggccggccgagcccgaagagcactcggtgaggatctgcatgagcccgggcccggagccgggagagcagatcctgtcggtgaagatgccggaggaaagggaggagaaggcggagtaa

SEQ ID NO: 22 - protein, 1251 aa, Homo sapiens
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSRRVLTWLMKGVEKVIPQPVHSITEDPAQILGHGSTGDTGCTDEPNEALEAQDTRPGLRLLLWLEQNLERVLPQPPKSSEVWRDEPAVATGAASDPAPPGRPQEMGPKLQARETPSLPTPIPLQPKEEPKEAPAPEPQPGSQAQTSSLPPTRDPARLVAWVLHRLEMALPQPVLHGKIGEQEPDSPGICDVQTISILPGGQVEPDLVLEEVEPPWEDAHQDVSTSPQGTEVVPAYEEENKAVEKMPRELSRIEEEKEDEEEEEEEEEEEEEEEVTEVLLDSCVVSQVGVGQSEEDGTRPQSTSDQKLWEEVGEEAKKEAEEKAKEEAEEVAEEEAEKEPQDWAETKEEPEAEAEAASSGVPATKQHPEVQVEDTDADSCPLMAEENPPSTVLPPPSPAKSDTLIVPSSASGTHRKKLPSEDDEAEELKALSPAESPVVAWSDPTTPKDTDGQDRAASTASTNSAIINDRLQELVKLFKERTEKVKEKLIDPDVTSDEESPKPSPAKKAPEPAPDTKPAEAEPVEEEHYCDMLCCKFKHRPWKKYQFPQSIDPLTNLMYVLWLFFVVMAWNWNCWLIPVRWAFPYQTPDNIHHWLLMDYLCDLIYFLDITVFQTRLQFVRGGDIITDKKDMRNNYLKSRRFKMDLLSLLPLDFLYLKVGVNPLLRLPRCLKYMAFFEFNSRLESILSKAYVYRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARRMLRSNNKPKEEKSVLILPPRAGTPKLFNAALAMTGKMGGKGAKGGKLAHLRARLKELAALEAAAKQQELVEQAKSSQDVKGEEGSAAPDQHTHPKEAATDPPAPRTPPEPPGSPPSSPPPASLGRPEGEEEGPAEPEEHSVRICMSPGPEPGEQILSVKMPEEREEKAE

SEQ ID NO: 23 - DNA, 2430 bp, Homo sapiens
atgtttaaatcgctgacaaaagtcaacaaggtgaagcctataggagagaacaatgagaatgaacaaagttctcgtcggaatgaagaaggctctcacccaagtaatcagtctcagcaaaccacagcacaggaagaaaacaaaggtgaagagaaatctctcaaaaccaagtcaactccagtcacgtctgaagagccacacaccaacatacaagacaaactctccaagaaaaattcctctggagatctgaccacaaaccctgaccctcaaaatgcagcagaaccaactggaacagtgccagagcagaaggaaatggaccccgggaaagaaggtccaaacagcccacaaaacaaaccgcctgcagctcctgttataaatgagtatgccgatgcccagctacacaacctggtgaaaagaatgcgtcaaagaacagccctctacaagaaaaagttggtagagggagatctctcctcacccgaagccagcccacaaactgcaaagcccacggctgtaccaccagtaaaagaaagcgatgataagccaacagaacattactacaggctgttgtggttcaaagtcaaaaagatgcctttaacagagtacttaaagcgaattaaacttccaaacagcatagattcatacacagatcgactctatctcctgtggctcttgcttgtcactcttgcctataactggaactgctgttttataccactgcgcctcgtcttcccatatcaaaccgcagacaacatacactactggcttattgcggacatcatatgtgatatcatctacctttatgatatgctatttatccagcccagactccagtttgtaagaggaggagacataatagtggattcaaatgagctaaggaaacactacaggacttctacaaaatttcagttggatgtcgcatcaataataccatttgatatttgctacctcttctttgggtttaatccaatgtttagagcaaataggatgttaaagtacacttcattttttgaatttaatcatcacctagagtctataatggacaaagcatatatctacagagttattcgaacaactggatacttgctgtttattctgcacattaatgcctgtgtttattactgggcttcaaactatgaaggaattggcactactagatgggtgtatgatggggaaggaaacgagtatctgagatgttattattgggcagttcgaactttaattaccattggtggccttccagaaccacaaactttatttgaaattgtttttcaactcttgaattttttttctggagtttttgtgttctccagtttaattggtcagatgagagatgtgattggagcagctacagccaatcagaactacttccgcgcctgcatggatgacaccattgcctacatgaacaattactccattcctaaacttgtgcaaaagcgagttcggacttggtatgaatatacatgggactctcaaagaatgctagatgagtctgatttgcttaagaccctaccaactacggtccagttagccctcgccattgatgtgaacttcagcatcatcagcaaagtcgacttgttcaagggttgtgatacacagatgatttatgacatgttgctaagattgaaatccgttctctatttgcctggtgactttgtctgcaaaaagggagaaattggcaaggaaatgtatatcatcaagcatggagaagtccaagttcttggaggccctgatggtactaaagttctggttactctgaaagctgggtcggtgtttggagaaatcagccttctagcagcaggaggaggaaaccgtcgaactgccaatgtggtggcccacgggtttgccaatcttttaactctagacaaaaagaccctccaagaaattctagtgcattatccagattctgaaaggatcctcatgaagaaagccagagtgcttttaaagcagaaggctaagaccgcagaagcaacccctccaagaaaagatcttgccctcctcttcccaccgaaagaagagacacccaaactgtttaaaactctcctaggaggcacaggaaaagcaagtcttgcaagactactcaaattgaagcgagagcaagcagctcagaagaaagaaaattctgaaggaggagaggaagaaggaaaagaaaatgaagataaacaaaaagaaaatgaagataaacaaaaagaaaatgaagataaaggaaaagaaaatgaagataaagataaaggaagagagccagaagagaagccactggacagacctgaatgtacagcaagtcctattgcagtggaggaagaaccccactcagttagaaggacagttttacccagagggacttctcgtcaatcactcattatcagcatggctccttctgctgagggcggagaagaggttcttactattgaagtcaaagaaaaggctaagcaataa

SEQ ID NO: 24 - protein, 809 aa, Homo sapiens
MFKSLTKVNKVKPIGENNENEQSSRRNEEGSHPSNQSQQTTAQEENKGEEKSLKTKSTPVTSEEPHTNIQDKLSKKNSSGDLTTNPDPQNAAEPTGTVPEQKEMDPGKEGPNSPQNKPPAAPVINEYADAQLHNLVKRMRQRTALYKKKLVEGDLSSPEASPQTAKPTAVPPVKESDDKPTEHYYRLLWFKVKKMPLTEYLKRIKLPNSIDSYTDRLYLLWLLLVTLAYNWNCCFIPLRLVFPYQTADNIHYWLIADIICDIIYLYDMLFIQPRLQFVRGGDIIVDSNELRKHYRTSTKFQLDVASIIPFDICYLFFGFNPMFRANRMLKYTSFFEFNHHLESIMDKAYIYRVIRTTGYLLFILHINACVYYWASNYEGIGTTRWVYDGEGNEYLRCYYWAVRTLITIGGLPEPQTLFEIVFQLLNFFSGVFVFSSLIGQMRDVIGAATANQNYFRACMDDTIAYMNNYSIPKLVQKRVRTWYEYTWDSQRMLDESDLLKTLPTTVQLALAIDVNFSIISKVDLFKGCDTQMIYDMLLRLKSVLYLPGDFVCKKGEIGKEMYIIKHGEVQVLGGPDGTKVLVTLKAGSVFGEISLLAAGGGNRRTANVVAHGFANLLTLDKKTLQEILVHYPDSERILMKKARVLLKQKAKTAEATPPRKDLALLFPPKEETPKLFKTLLGGTGKASLARLLKLKREQAAQKKENSEGGEEEGKENEDKQKENEDKQKENEDKGKENEDKDKGREPEEKPLDRPECTASPIAVEEEPHSVRRTVLPRGTSRQSLIISMAPSAEGGEEVLTIEVKEKAKQ

SEQ ID NO: 25 - DNA, 5568 bp, Homo sapiens
atggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacgaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 26 - protein, 1855 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCELMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 27 - DNA, 5547 bp, Homo sapiens
atgtcggtgggcgagctctacagccagtgcacaagggtctggatccctgaccctgatgaggtatggcgctcagctgagttaaccaaggactacaaagaaggagacaagagcctacagctcagactggaggatgaaacgattctggaatacccaattgatgtacaacgcaaccagctgcccttcttacggaatccagatatcttggtgggagaaaatgacctgactgcccttagctatcttcatgagcctgcagttttgcataatttgaaggtccgtttcctggagtccaaccatatctacacttactgtggtatcgtacttgttgccattaatccttatgaacagttgccaatctatggacaagatgtcatctatacctacagtggccaaaacatgggagacatggacccccacatctttgctgtggcagaagaagcctacaagcagatggccagagatgagaagaatcagtccatcatagtcagtggggagtctggagccgggaagacggtatcagccaagtatgccatgcgctatttcgccaccgttggtggctcggccagtgaaaccaacatcgaagagaaggtgctggcatccagtcccatcatggaggccattggaaatgccaagaccacccgcaatgacaacagcagccgttttggcaagtacatccagattggctttgacaaaaggtaccacatcatcggggccaacatgaggacttacctcttggagaagtccagagtggtcttccaggcagatgatgagaggaattaccacatcttttaccagctctgtgctgctgccggtcttccagaatttaaagagcttgcactaacaagtgcagaggactttttctatacatcacagggaggagacacttccatcgagggtgtggacgatgctgaggactttgagaagactcgacaagccttcacactcctcggagtgaaagagtcccatcagatgagcatttttaagataattgcttctatcttgcaccttggaagtgtggcgattcaggctgagcgtgatggtgattcctgtagtatatcaccccaggatgtatacctaagcaacttctgccgactgctaggggtggagcacagtcagatggagcactggctgtgtcatcgcaagctggtcaccacctcggagacctacgtcaagaccatgtccctgcagcaggtgatcaatgcgcgcaacgccctggcgaagcacatctatgcccagttgttcggctggattgtggagcacatcaacaaggccctgcacacctccctcaagcagcactccttcatcggggtcctggacatctatgggtttgagacatttgaggtaaacagctttgagcagttctgtatcaactatgcaaatgaaaagctccagcagcagttcaactcgcatgttttcaaactggagcaagaagaatacatgaaggaacagatcccttggaccctgattgatttttatgataaccaaccttgtatcgacctcattgaagccaagctgggtatcttggacctgttggatgaagaatgtaaggtccccaaaggaactgaccagaactgggctcagaagctctatgaccggcactccagcagccagcacttccagaagccccgcatgtccaacacggccttcatcatcgtccactttgcagacaaggtggagtacctctctgatggttttctggagaaaaacagagacacggtgtatgaagagcagatcaatatcctgaaggccagcaagttcccactagtggctgacttgtttcatgatgacaaggaccctgttcctgccaccacccctgggaaggggtcatcttcgaagatcagcgtccgttctgccagaccccccatgaaagtctccaacaaggagcacaagaaaaccgttggccaccagttccgtacctccctgcatctgctcatggagaccctgaatgccacgacacctcactatgtccgctgcatcaagcccaacgatgagaagctcccctttcactttgacccaaagagagcagtgcagcaactcagagcctgcggggtgttggagacgattcgaatcagtgcagctggctacccatccaggtgggcctaccatgactttttcaaccggtatcgggtgctggtcaagaagagagagctcgccaacacagacaaaaaggccatctgcaggtctgtcctggagaacctcatcaaggaccccgacaagttccagtttggccgcaccaagatcttctttcgagcaggccaggtggcctacctggagaagctgcgggctgacaagttccggacagccaccatcatgatccagaaaactgtccggggatggctgcagaaggtgaaatatcacaggctgaagggggctaccttaaccctgcagaggtactgccggggacacctggcccgcaggctggctgagcacctgcggaggatcagagcggctgtggtgctccagaaacattaccgcatgcagagggcccgccaggcctaccagagggtccgcagagctgccgttgttatccaggccttcacccgggccatgtttgtgcggagaacctaccgccaggtcctcatggagcacaaggccaccaccatccagaagcacgtgcggggctggatggcacgcaggcacttccagcggctgcgggatgcagccattgtcatccagtgtgccttccggatgctcaaggccaggcgggagctgaaggccctcaggattgaggcccgctcagcagagcatctgaaacgtctcaacgtgggcatggagaacaaggtggtccagctgcagcggaagatcgatgagcagaacaaagagttcaagacactttcagagcagttgtccgtgaccacctcaacatacaccatggaggtagagcggctgaagaaggagctggtgcactaccagcagagcccaggtgaggacaccagcctcaggctgcaggaggaggtggagagcctgcgcacagagctgcagagggcccactcggagcgcaagatcttggaggacgcccacagcagggagaaagatgagctgaggaagcgagttgcagacctggagcaagaaaatgctctcttgaaagatgagaaagaacagctcaacaaccaaatcctgtgccagtctaaagatgaatttgcccagaactctgtgaaggaaaatctcatgaagaaagaactggaggaggagcgatcccggtaccagaaccttgtgaaggaatattcacagttggagcagagatacgacaaccttcgggatgaaatgaccatcataaagcaaactccaggtcataggcggaacccatcaaaccaaagtagcttagaatctgactccaattacccctccatctccacatctgagatcggagacactgaggatgccctccagcaggtggaggaaattggcctggagaaggcagccatggacatgacggtcttcctgaagctgcagaagagagtacgggagctggagcaggagaggaaaaagctgcaagtgcagctggagaagagagaacagcaggacagcaagaaagtccaggcggaaccaccacagactgacatagatttggacccgaatgcagatctggcctacaatagtctgaagaggcaagagctggagtcagagaacaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggagccgaacattaatgccagatcaagttggcctaacagtgaaaagcatgttgaccaggaggatgccattgaggcctatcacggggtctgccagacaaacagcaagactgaggattggggatatttaaatgaagatggagaactcggcttggcctaccaaggcctaaagcaagttgccaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctga

SEQ ID NO: 28 - protein, 1848 aa, Homo sapiens
MSVGELYSQCTRVWIPDPDEVWRSAELTKDYKEGDKSLQLRLEDETILEYPIDVQRNQLPFLRNPDILVGENDLTALSYLHEPAVLHNLKVRFLESNHIYTYCGIVLVAINPYEQLPIYGQDVIYTYSGQNMGDMDPHIFAVAEEAYKQMARDEKNQSIIVSGESGAGKTVSAKYAMRYFATVGGSASETNIEEKVLASSPIMEAIGNAKTTRNDNSSRFGKYIQIGFDKRYHIIGANMRTYLLEKSRVVFQADDERNYHIFYQLCAAAGLPEFKELALTSAEDFFYTSQGGDTSIEGVDDAEDFEKTRQAFTLLGVKESHQMSIFKIIASILHLGSVAIQAERDGDSCSISPQDVYLSNFCRLLGVEHSQMEHWLCHRKLVTTSETYVKTMSLQQVINARNALAKHIYAQLFGWIVEHINKALHTSLKQHSFIGVLDIYGFETFEVNSFEQFCINYANEKLQQQFNSHVFKLEQEEYMKEQIPWTLIDFYDNQPCIDLIEAKLGILDLLDEECKVPKGTDQNWAQKLYDRHSSSQHFQKPRMSNTAFIIVHFADKVEYLSDGFLEKNRDTVYEEQINILKASKFPLVADLFHDDKDPVPATTPGKGSSSKISVRSARPPMKVSNKEHKKTVGHQFRTSLHLLMETLNATTPHYVRCIKPNDEKLPFHFDPKRAVQQLRACGVLETIRISAAGYPSRWAYHDFFNRYRVLVKKRELANTDKKAICRSVLENLIKDPDKFQFGRTKIFFRAGQVAYLEKLRADKFRTATIMIQKTVRGWLQKVKYHRLKGATLTLQRYCRGHLARRLAEHLRRIRAAVVLQKHYRMQRARQAYQRVRRAAVVIQAFTRAMFVRRTYRQVLMEHKATTIQKHVRGWMARRHFQRLRDAAIVIQCAFRMLKARRELKALRIEARSAEHLKRLNVGMENKVVQLQRKIDEQNKEFKTLSEQLSVTTSTYTMEVERLKKELVHYQQSPGEDTSLRLQEEVESLRTELQRAHSERKILEDAHSREKDELRKRVADLEQENALLKDEKEQLNNQILCQSKDEFAQNSVKENLMKKELEEERSRYQNLVKEYSQLEQRYDNLRDEMTIIKQTPGHRRNPSNQSSLESDSNYPSISTSEIGDTEDALQQVEEIGLEKAAMDMTVFLKLQKRVRELEQERKKLQVQLEKREQQDSKKVQAEPPQTDIDLDPNADLAYNSLKRQELESENKKLKNDLNELRKAVADQATQNNSSHGSPDSYSLLLNQLKLAHEELEVRKEEVLILRTQIVSADQRRLAGRNAEPNINARSSWPNSEKHVDQEDAIEAYHGVCQTNSKTEDWGYLNEDGELGLAYQGLKQVARLLEAQLQAQSLEHEEEVEHLKAQLEALKEEMDKQQQTFCQTLLLSPEAQVEFGVQQEISRLTNENLDLKELVEKLEKNERKLKKQLKIYMKKAQDLEAAQALAQSERKRHELNRQVTVQRKEKDFQGMLEYHKEDEALLIRNLVTDLKPQMLSGTVPCLPAYILYMCIRHADYTNDDLKVHSLLTSTINGIKKVLKKHNDDFEMTSFWLSNTCRLLHCLKQYSGDEGFMTQNTAKQNEHCLKNFDLTEYRQVLSDLSIQIYQQLIKIAEGVLQPMIVSAMLENESIQGLSGVKPTGYRKRSSSMADGDNSYCLEAIIRQMNAFHTVMCDQGLDPEIILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 29 - DNA, 5229 bp, Homo sapiens
atggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaatgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcaggcaagcagcacacttttattggtgttttggacatttatggttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcttcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccggaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgaggaaagctattactgcagtggccttaaaagaagcttgggcagccataatcattcagaagcactgccgcgggtatcttgttcgcagcctgtatcagttgattcgcatggccaccatcacaatgcaggcctacagccgaggattcctggcaaggaggaggtatcgaaagatgctggaggaacataaggctgtgatcctacagaaatacgcacgggcgtggctggccagacgcagattccagagtatccgacgattcgtgcttaatattcagcttacttacagggtccagcgtttgcagaaaaagttggaagatcagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaagaaaaaatggacaacctcaccaagcagctctttgatgatgtacaaaaggaagaacggcaaagaatgcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaagacaatctctgagttcgaaaaagagatagaactacttcaggcacagaagatagatgtggagaaacatgtgcagtcacaaaaacgggaaatgagagaaaagatgtcagagatcaccaaacaacttctcgaaagctatgacattgaagatgtaagaagcaggctctctgtggaagatctggaacatttaaatgaggatggagaactttggtttgcttatgaaggactaaagaaagcaacacgtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagccaatgatgtgcactcgtcctcaggacccaaggagtaccttggaatgctgcaatacaagagagaagacgaggccaagctcattcagaacctcattcttgacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcagatcataaagatccttaattcatacacacctatagatgactttgagaagagagtgactccatcctttgttcgcaaagtacaggctctcctaaatagccgggaggattcatcacagctgatgttggataccaaatatctctttcaagtcacatttccttttaccccctctccacatgctctggaaatgattcagatccccagcagtttcaagctaggctttctgaataggttatag

SEQ ID NO: 30 - protein, 1742 aa, Homo sapiens
MAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQSENERNYHIFYQLCASAQQSEFKHLKLGSAEEFNYTRMGGNTVIEGVNDRAEMVETQKTFTLLGFKEDFQMDVFKILAAILHLGNVQITAVGNERSSVSEDDSHLKVFCELLGLESGRVAQWLCNRKIVTSSETVVKPMTRPQAVNARDALAKKIYAHLFDFIVERINQALQFSGKQHTFIGVLDIYGFETFDVNSFEQFCINYANEKLQQQFNMHVFKLEQEEYMKEDIPWTLIDFYDNQPVIDLIEAKMGILELLDEECLLPHGTDENWLQKLYNNFVNRNPLFEKPRMSNTSFVIQHFADKVEYKCEGFLEKNRDTVYDMLVEILRASKFHLCANFFQENPTPPSPFGSMITVKSAKQVIKPNSKHFRTTVGSKFRSSLYLLMETLNATTPHYVRCIKPNDEKLPFEFDSKRIVQQLRACGVLETIRISAQSYPSRWTYIEFYSRYGILMTKQELSFSDKKEVCKVVLHRLIQDSNQYQFGKTKIFFRAGQVAYLEKLRLDKLRQSCVMVQKHMRGWLQRKKFLRERRAALIIQQYFRGQQTVRKAITAVALKEAWAAIIIQKHCRGYLVRSLYQLIRMATITMQAYSRGFLARRRYRKMLEEHKAVILQKYARAWLARRRFQSIRRFVLNIQLTYRVQRLQKKLEDQNKENHGLVEKLTSLAALRAGDVEKIQKLEAELEKAATHRRNYEEKGKRYRDAVEEKLAKLQKHNSELETQKEQIQLKLQEKTEELKEKMDNLTKQLFDDVQKEERQRMLLEKSFELKTQDYEKQIQSLKEEIKALKDEKMQLQHLVEGEHVTSDGLKAEVARLSKQVKTISEFEKEIELLQAQKIDVEKHVQSQKREMREKMSEITKQLLESYDIEDVRSRLSVEDLEHLNEDGELWFAYEGLKKATRVLESHFQSQKDCYEKEIEALNFKVVHLSQEINHLQKLFREENDINESIRHEVTRLTSENMMIPDFKQQISELEKQKQDLEIRLNEQAEKMKGKLEELSNQLHRSQEEEGTQRKALEAQNEIHTKEKEKLIDKIQEMQEASDHLKKQFETESEVKCNFRQEASRLTLENRDLEEELDMKDRVIKKLQDQVKTLSKTIGKANDVHSSSGPKEYLGMLQYKREDEAKLIQNLILDLKPRGVVVNMIPGLPAHILFMCVRYADSLNDANMLKSLMNSTINGIKQVVKEHLEDFEMLSFWLSNTCHFLNCLKQYSGEEEFMKHNSPQQNKNCLNNFDLSEYRQILSDVAIRIYHQFIIIMEKNIQPIIVPGMLEYESLQGISGLKPTGFRKRSSSIDDTDGYTMTSVLQQLSYFYTTMCQNGLDPELVRQAVKQLFFLIGAVTLNSLFLRKDMCSCRKGMQIRCNISYLEEWLKDKNLQNSLAKETLEPLSQAAWLLQVKKTTDSDAKEIYERCTSLSAVQIIKILNSYTPIDDFEKRVTPSFVRKVQALLNSREDSSQLMLDTKYLFQVTFPFTPSPHALEMIQIPSSFKLGFLNRL

SEQ ID NO: 31 - DNA, 6648 bp, Homo sapiens
atggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcagggagtgccgtgtctggctctcactgggctgctctgatcttggctgtgctgcgcctcactcaggctgggcaggactgaccccggcggggccctgttctccgtgttggtcctgcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtga

SEQ ID NO: 32 - protein, 2215 aa, Homo sapiens
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRECRVWLSLGCSDLGCAAPHSGWAGLTPAGPCSPCWSCRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 33 - DNA, 6351 bp, Homo sapiens
atgtcggggttcaggctgggtgaccacgtgtggctggagcctccctccacccacaagaccggcgtggccatcgggggcatcatcaaagaggcaaagccaggcaaagtcttggttgaagatgacgagggcaaggaacactggatccgagcagaggactttggtgtcctcagtcccatgcaccccaactcagtccagggtgtggacgacatgatccgcctgggggacctgaacgaggcaggcatggtgcacaacctcctgatccgctaccagcagcacaagatctatacatacacaggctccatcctggtggccgtcaacccgttccaggtgctgccgctctacaccctggagcaggtacagctctactacagccgccatatgggcgagctgcccccgcatgtctttgccatcgccaacaactgctacttcagcatgaagaggaacaagagggaccagtgctgcatcatcagcggcgagtctggggctggcaagacggagaccaccaagctcatcctgcagttcctggccaccatcagtggccagcattcgtggattgagcagcaggtcctggaagccaaccccatcctggaggcctttggaaatgccaagacaatccgcaacgacaactcaagccgctttgggaagtacattgacatctactttaaccccagcggggtgatcgagggcgcgcgcatcgagcaatttctcctggagaagtcccgggtctgccggcaggctcccgaggagcggaactaccatatcttctactgcatgctcatgggggtgagtgctgaggacaagcagctgctgagcctgggcacgccctccgagtaccactacctgaccatggggaactgcacttcctgtgaggggctcaacgacgccaaggactacgcccacatccgctcggccatgaagatcctccagttctccgactccgagagctgggacgtcatcaagctgctggctgccattctccacctggggaatgtggggttcatggcttcggtcttcgagaacctggacgcctcagacgtgatggagacgcccgcctttcccaccgtgatgaagttactggaggtgcagcaccaggagctccgggactgtctgatcaagcacaccatcctcatccgaggggaatttgtcaccaggtccctgaacattgcccaggctgctgaccggagggacgcctttgtcaagggcatctatgggcacctcttcctgtggattgtcaagaagatcaatgccgccatcttcacaccaccagcccaggaccccaaaaatgtgcggagggccatcggcctcctggacatatttggctttgaaaatttcgagaacaatagcttcgagcagctctgcatcaacttcgccaacgagcacctgcagcagttctttgtgcagcacgtgttcaccatggagcaagaggagtaccgctcggagaacatctcctgggactatatccactacaccgacaatcggcccaccctggacctgctggccctcaagcccatgagcatcatctccctcctggacgaagaaagccgcttcccgcaggggacagatctcaccatgctgcaaaagctgaacagcgtccatgccaacaacaaggccttcctacagcccaagaacatccacgatgccagatttggcattgcccattttgccggcgaggtgtactaccaagcagaaggcttcctggagaagaaccgagacgtgctgagcacagatatcctcaccctggtttactcctccaaaaacaagtttctgagggagatattcaacttggagttagcagagaccaagctgggccatgggaccatccgccaggcaaaggcaggaaaccatctcttcaagtctgcagactcaaataaacggccctccaccttaggaagccagttcaaacagtctctggaccagctgatgaaaatcctgaccaactgccagccttacttcatccgctgcatcaaacctaatgagtacaagaagccgctgctgttcgaccgggagctgtgcctgcggcagctgcgatactcgggcatgatggagaccgtgcacatccgcaagtcgggcttccccatccgctacacgttcgaggagttctcgcagaggttcggcgtgttgctgcccaacgccatgcggatgcagctgcaaggcaagctccgccagatgaccctgggcatcactgacgtgtggctgcggacagacaaagactggaaagcggggaagacaaaaattttcctgagggatcatcaggacactctgctggaggtacagagaagccaggtgctagacagagcggcgctcagcatccagaaagtccttcggggctacagatacaggaaggagttcctgaggcagaggcgggcagctgtgaccctgcaggcctggtggagaggctactgcaacaggaggaatttcaagctgatcctcgtgggctttgagcgcctgcaggctattgcccggagccagccgctggcgaggcagtaccaggccatgcggcagaggacagtccagctgcaggccctgtgcaggggatacctggtgcgccagcaagtccaggccaagaggagggcagtggtggtcattcaggcccatgccaggggcatggctgcccggcgcaacttccagcaaaggaaggccaatgcgccgctggtcatcccggccgaggggcagaaaagccaaggcgctctccctgccaagaagcgcagatccatctacgacaccgtcactgacacggagatggtggagaaggtgttcggcttcctccctgccatgattgggggccaggagggccaggcctcgccgcactttgaggatctggaatcgaagacccagaagctgcttgaggttgacctggacacagtccccatggcggaggagcctgaggaggatgtggatggcctggccgagtacaccttccccaagtttgctgtgacttacttccagaaatcagccagccacacacacatccggcggcccctccgatacccgttgctttaccacgaagatgacactgactgcttggccgccctggtcatatggaacgtcatcctgaggttcatgggtgatctcccagagccagtgctgtatgccaggagcagccagcagggcagctcagtgatgcggcagatccatgacacgctgggcagggagcacggtgcccaggttccacagcacagtagatctgcacaggtggccagccagctgaacattggagaggaggcattggagcctgatggccttggtgcagaccggcccatgtccaacctggagaaggtgcacttcatcgtgggctacgccatcctgcggcccagcctcagggatgagatttactgccagatctgcaagcagctctcggagaacttcaaaacaagcagcctggcccggggctggatcctgctcagcctctgcctcggctgcttcccaccctcagagaggttcatgaagtatctactgaacttcatcggccaagggccggcgacctacggccccttctgtgccgagcgcctgagacgcacctatgccaatggggtgcgtgcggagccccccacctggctggagctgcaggctgtcaagtccaagaagcacatccccatccaagtcatcttggccactggagagagcctaaccgtccccgtggactcagcctccacatctcgggaaatgtgcatgcacatcgctcacaagcagggcctcagcgaccacctgggcttctccctccaggtcgccgtgtacgacaagttctggtccctgggcagcgggcgcgaccacatgatggatgccatcgcccggtgtgagcagatggcccaggagaggggcgagagccagcgccagtcaccctggcgcatctacttccggaaggaattcttcaccccctggcacgactcccgggaggaccctgtcagcaccgagcttatttaccgccaagtcctccgaggagtctggtctggcgagtacagcttcgagaaggaggaagagctggttgagctgctggcccggcactgctacgtgcagctcggcgcctcagcagagagcaaggctgtccaggagctgctgcccagctgcatcccccacaagctgtacaggaccaagcccccagacaggtgggcgagcctcgtcactgccgcctgcgccaaggccccatacactcagaagcaagtcacaccactggccgtgcgagagcaggtggtggacgccgcccgcctgcagtggccgctgctcttctcccggctcttcgaagtcatcacactctcaggcccccgcctgcccaagacgcagctgatcttggctgttaactggaaggggctttgcttcctggaccagcaggagaagatgctgctggaactctctttcccagaggtcatgggtctggccaccaacagggaggcccagggcgggcagaggctgctgctctccacgatgcatgaggagtacgagtttgtgtcacccagcagtgtggccatcgctgagctggtggccctgttcctggagggcctgaaggagaggtccattttcgccatggccctgcaggacaggaaggccacagatgacaccaccctcctggccttcaagaagggggacctgttggtcctcacaaagaagcaggggctgctggcctctgagaactggaccctcggccagaacgacaggacaggcaagacggggctggtgcccatggcctgcctctacaccatccccacggtcactaagccctcggcacagctgctgagcttgcttgccatgtcaccagagaagaggaagctggcggctcaggaggggcagttcacagagccacgtcctgaggagccacccaaggaaaagctgcacaccctggaggagttctcctatgagttcttcagggctccagagaaggacatggtgagcatggccgtgctgcccctggcccgtgcccgtggccacctgtgggcctattcctgcgagccgctgcgacagccgctgctcaagcgagtccacgccaacgtcgacctctgggacatcgcctgccagatctttgtcgccatcctccggtacatgggcgactacccttctcggcaggcctggcccaccctggagctcaccgaccagatcttcacactggccctgcagcacccggccctccaggacgaggtctactgccagatcctgaagcagctgacgcacaactccaacaggcacagcgaagagcggggctggcagctgctgtggctgtgcacgggcctcttcccgcccagcaaggggctgctgccccatgcccagaagtttatagacactcggagggggaagctgctggcccccgactgcagccgccgaatccagaaggtcctgaggacggggccccggaagcagcccccgcaccaggtggaggtggaggccgcagagcagaacgtctcccgcatctgccacaagatctacttccccaatgacaccagtgagatgctggaggtggttgccaacacacgggtgcgggatgtgtgtgacagcattgccaccaggctgcagctggcctcctgggagggctgcagcctcttcatcaagatttcagacaaggtcatcagccagaaggagggagacttcttctttgattccttgagggaggtgtctgactgggtgaagaagaacaagccccagaaagaaggggcccccgtgacgctcccctaccaggtgtacttcatgcggaaattgtggctcaacatatctccagggaaggatgtgaatgcagacaccatactccattaccaccaggagctgcccaagtacctgcgcggattccacaagtgttcgcgggaggatgccatccacctggcgggcctcatctacaaggcccagttcaacaacgaccggtcccagctggctagtgtccccaagatcctgagggaactggtgcctgagaacctcacacgcctgatgtcctcggaggagtggaaaaagagcatccttctagcctatgacaagcataaggacaagacagtggaggaggccaaggtggccttcctgaagtggatctgccggtggcccaccttcggatccgccttcttcgaggtgaagcaaacctcggagccttcctacccggacgtcatcctcatcgccatcaaccgacatggggttctgctcatccaccccaagaccaaggacctgctcaccacctatcccttcaccaagatctccagctggagcagcggcagcacctacttccacatggcgctggggagcctgggccgtggcagccgcctgctgtgcgagacctccctgggctataagatggatgacctgctgacctcatatgtgcagcagctcctgagtgccatgaacaagcagcggggctccaaggccccagccctggccagcacctag

SEQ ID NO: 34 - protein, 2116 aa, Homo sapiens
MSGFRLGDHVWLEPPSTHKTGVAIGGIIKEAKPGKVLVEDDEGKEHWIRAEDFGVLSPMHPNSVQGVDDMIRLGDLNEAGMVHNLLIRYQQHKIYTYTGSILVAVNPFQVLPLYTLEQVQLYYSRHMGELPPHVFAIANNCYFSMKRNKRDQCCIISGESGAGKTETTKLILQFLATISGQHSWIEQQVLEANPILEAFGNAKTIRNDNSSRFGKYIDIYFNPSGVIEGARIEQFLLEKSRVCRQAPEERNYHIFYCMLMGVSAEDKQLLSLGTPSEYHYLTMGNCTSCEGLNDAKDYAHIRSAMKILQFSDSESWDVIKLLAAILHLGNVGFMASVFENLDASDVMETPAFPTVMKLLEVQHQELRDCLIKHTILIRGEFVTRSLNIAQAADRRDAFVKGIYGHLFLWIVKKINAAIFTPPAQDPKNVRRAIGLLDIFGFENFENNSFEQLCINFANEHLQQFFVQHVFTMEQEEYRSENISWDYIHYTDNRPTLDLLALKPMSIISLLDEESRFPQGTDLTMLQKLNSVHANNKAFLQPKNIHDARFGIAHFAGEVYYQAEGFLEKNRDVLSTDILTLVYSSKNKFLREIFNLELAETKLGHGTIRQAKAGNHLFKSADSNKRPSTLGSQFKQSLDQLMKILTNCQPYFIRCIKPNEYKKPLLFDRELCLRQLRYSGMMETVHIRKSGFPIRYTFEEFSQRFGVLLPNAMRMQLQGKLRQMTLGITDVWLRTDKDWKAGKTKIFLRDHQDTLLEVQRSQVLDRAALSIQKVLRGYRYRKEFLRQRRAAVTLQAWWRGYCNRRNFKLILVGFERLQAIARSQPLARQYQAMRQRTVQLQALCRGYLVRQQVQAKRRAVVVIQAHARGMAARRNFQQRKANAPLVIPAEGQKSQGALPAKKRRSIYDTVTDTEMVEKVFGFLPAMIGGQEGQASPHFEDLESKTQKLLEVDLDTVPMAEEPEEDVDGLAEYTFPKFAVTYFQKSASHTHIRRPLRYPLLYHEDDTDCLAALVIWNVILRFMGDLPEPVLYARSSQQGSSVMRQIHDTLGREHGAQVPQHSRSAQVASQLNIGEEALEPDGLGADRPMSNLEKVHFIVGYAILRPSLRDEIYCQICKQLSENFKTSSLARGWILLSLCLGCFPPSERFMKYLLNFIGQGPATYGPFCAERLRRTYANGVRAEPPTWLELQAVKSKKHIPIQVILATGESLTVPVDSASTSREMCMHIAHKQGLSDHLGFSLQVAVYDKFWSLGSGRDHMMDAIARCEQMAQERGESQRQSPWRIYFRKEFFTPWHDSREDPVSTELIYRQVLRGVWSGEYSFEKEEELVELLARHCYVQLGASAESKAVQELLPSCIPHKLYRTKPPDRWASLVTAACAKAPYTQKQVTPLAVREQVVDAARLQWPLLFSRLFEVITLSGPRLPKTQLILAVNWKGLCFLDQQEKMLLELSFPEVMGLATNREAQGGQRLLLSTMHEEYEFVSPSSVAIAELVALFLEGLKERSIFAMALQDRKATDDTTLLAFKKGDLLVLTKKQGLLASENWTLGQNDRTGKTGLVPMACLYTIPTVTKPSAQLLSLLAMSPEKRKLAAQEGQFTEPRPEEPPKEKLHTLEEFSYEFFRAPEKDMVSMAVLPLARARGHLWAYSCEPLRQPLLKRVHANVDLWDIACQIFVAILRYMGDYPSRQAWPTLELTDQIFTLALQHPALQDEVYCQILKQLTHNSNRHSEERGWQLLWLCTGLFPPSKGLLPHAQKFIDTRRGKLLAPDCSRRIQKVLRTGPRKQPPHQVEVEAAEQNVSRICHKIYFPNDTSEMLEVVANTRVRDVCDSIATRLQLASWEGCSLFIKISDKVISQKEGDFFFDSLREVSDWVKKNKPQKEGAPVTLPYQVYFMRKLWLNISPGKDVNADTILHYHQELPKYLRGFHKCSREDAIHLAGLIYKAQFNNDRSQLASVPKILRELVPENLTRLMSSEEWKKSILLAYDKHKDKTVEEAKVAFLKWICRWPTFGSAFFEVKQTSEPSYPDVILIAINRHGVLLIHPKTKDLLTTYPFTKISSWSSGSTYFHMALGSLGRGSRLLCETSLGYKMDDLLTSYVQQLLSAMNKQRGSKAPALAST

SEQ ID NO: 35 - DNA, 6177 bp, Homo sapiens
atggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtga

SEQ ID NO: 36 - protein, 2058 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVREVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGSEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 37 - DNA, 10593 bp, Homo sapiens
atggcgaaggaggaagatgaggagaagaaagccaagaaagggaagaaggggaagaaggcaccggagccggagaagcccaaacggagcctgaaggggacgtcgcggctgttcatgggcttccgcgaccgtacacccaagatctccaagaagggccagttccgcagcgcctcggccttcttctggggcctccacaccggcccccagaagaccaagcgcaagaggaaggcccgcaccgtgctcaagtccacgtcaaagctcatgacgcagatgcgcatgggcaagaagaagcgggcgatgaagggcaagaagccgtccttcatggtgatccgcttcccaggccgccgtggctacggccgcctgcggccgcgcgcccggtcactcagcaaagcgtccacggccatcaactggctcacaaaaaagttcctcctcaagaaggccgaggagtcgggcagcgaacaggccacagtggacgcctggctgcagcgctcgagctcccgcatgggctcccgcaaactccccttcccgtcgggtgccgagatcctgcggcctgggggccggctccggaggttcccccgcagccgcagcatctacgcgtcaggcgagcccctgggcttcctgcccttcgaggacgaggccccattccatcactcgggctcccgcaagtcgctgtacgggcttgagggcttccaggacctgggcgagtattatgactatcaccgcgacggcgacgactactacgaccggcagtcactccaccgctacgaggagcaggaaccctacctggcgggcctcggcccctacagcccggcctggccaccctacggcgaccactactacgggtacccgcccgaggatccctacgactactaccaccccgactattacggtggcccctttgatccggggtacacctacggctacggctacgacgattacgaacccccatatgcgcccccgtcggggtactcgtctccttacagctaccacgatgggtacgagggcgaggcgcacccttatggctactacctggatccctatgcgccgtacgacgcgccatacccaccctatgacctcccataccacactccctacgatgtaccctactttgatccctacggagtccactacaccgtcccctatgccgaaggcgtctatggcggtggggacgaggccatctacccccccgaggtgccctatttttacccggaggagtcggcttcggcctttgtgtacccctgggtaccaccgcccatcccgtcgccccacaacccgtatgcccacgccatggatgacatcgccgagctggaggaaccagaggacgcgggcgtagagcgtcaggggacctccttccgcctgcccagcgccgccttcttcgagcagcaaggcatggataagcccgccaggtccaagctgtccctcatccgcaagttccgcctcttcccgcgaccccaggtgaagctgtttgggaaggagaagctggaggtgcccctgccaccctctctggacattcctctccccttgggggatgcggacgaagaagaggacgaggaggagctgcccccggtttccgctgtgccctacggccaccctttctggggcttcctcacgccgcgccagcgcaacctccagcgcgcgctgtcggccttcggcgcccaccggggcctgggcttcggccctgagtttggccgccccgtgcctcgccctgccacctcgcttgcgcggttcctcaagaagacgctgtcggagaagaagcccatcgcgcggctcaggggcagccagaaggcccgggcgggcggccctgctgtcagggaggcggcctacaaacgcttcggctacaagctggctggcatggaccccgagaagcccggcacgcccatcgtgctgaggagggcccagccacgcgctcgcagcagcaacgacgcgcgccgcccgcccgcgccacagcccgcgcccaggaccctctcccactggagcgcgctcctgtctccgcccgtgcccccgcggcccccaagctccgggcccccgcccgcgccgccgctctccccggcgctctcgggcctgccccggccggcctcgccctacggctccctccgccgccacccgccgccctgggccgccccagcgcacgtgccaccggcgccgcaggccagctggtgggccttcgtggagccccctgccgtgagcccggaggtgccccccgacctactagccttcccagggccccgaccctcgttcaggggctcccgccggagaggggcggctttcggcttccccggggcctctccacgggcgtcgcggaggcgagcttggtcaccgctggcctcgccccagccctcgctgaggagctcgccgggcctcggctactgctcacccttggcgcccccgtcgcctcagctgtccttgcgcacgggccccttccagccgcccttcctgcccccggcccgccggccccgctcgctgcaggagtccccagccccacgccgagccgctgggcgcctgggcccacccggctcgccgctgccgggctcacccaggccgccctcgccgcccctggggctctgccacagcccgcggcgcagctccctgaatctgccctcgcgcctcccgcacacgtggcggcgcctcagcgagccacccactcgggctgtgaagccgcaagtgcgcctgcccttccaccgaccgcccagggccggggcctggcgggcgcccctggaacaccgggagagcccgcgagaacccgaggactcagagacgccctggactgtgcccccactggcccccagctgggacgtggacatgcctcccacccaacgcccaccctccccctggccaggaggtgcaggcagccgccgaggcttttccaggccaccccctgtgccggaaaacccctttctccagctcctgggccctgtgccatcccccaccctccagcctgaggatccagctgctgatatgaccagggtcttcctgggcagacaccatgagccggggcctggacagctcaccaaatcagctggcccaacccctgagaagcctgaagaagaggccaccctgggggacccccagctgccagcagagaccaagcctccaaccccagcacctcccaaggatgtcactccccccaaggatatcactccccccaaggatgtcctcccagagcaaaagacattaaggcccagcctctcatacccactggctgcgtgtgaccagaccagggccacatggccaccatggcaccgctggggaacactgccccaagccgcagcccccttggcgcccatcagggccccagagcccctgcccaaggggggtgaacggcgccaggcagcccctgggcgttttgctgtggtcatgcctcgtgtgcagaagctgagctctttccagcgagttgggcctgcaaccctgaagcctcaagtccagcccattcaggaccccaagccaagagcctgtagtcttcgctggtcctgcctctggcttcgggcagatgcctatggaccctggccacgagtacacacccatccccagtcctgccacctgggccctggagctgcctgcctgtcccttaggggctcctgggaggaggtcggcccgccaagctggcggaacaagatgcactccatccgcaacctgccatccatgcggttccgtgagcagcacggggaggatggtgtggaggacatgacacagctggaagacctccaggaaaccactgtgctgtccaacctcaagattagatttgaacggaacctcatctacacatacattgggagcatcctggtgtcggtgaacccataccaaatgtttggaatctatgggccggagcaggtgcagcagtacaacggacgggccctgggagagaatcccccgcacctctttgctgttgcaaatctcgccttcgccaaaatgctcgatgccaaacagaaccagtgcataatcattagtggagagagcggctctggcaaaactgaggccaccaagctgattctgcgctacctggccgccatgaaccagaaacgggaggtcatgcagcagataaagatcctggaggcaacacccctcttggagtccttcggtaatgccaaaaccgtcaggaacgacaactccagccgctttgggaagtttgtggaaatctttctggaagggggcgtgatctctggtgccataacctcccagtacctgcttgagaaatccaggatcgtgtttcaggccaaaaacgagaggaattaccacatcttctacgagttgctggccgggttgcctgcccagctcaggcaggcctttagcctgcaagaggctgagacctactactatctgaaccagggtgggaactgtgagatagcaggaaagagcgatgcagatgactttcgccggctcctggctgccatggaggtgttgggcttcagcagtgaggaccaggacagcatcttccgcatcctggcctccatcctgcacctgggcaacgtctactttgagaagtatgagacggatgcacaggaggtggcctcagtggtgagtgcccgagagatccaggccgtggcagagctgctgcagatctcccctgagggcctgcagaaggccatcaccttcaaagtgaccgagacaatgcgagagaagatcttcacgcccctaactgtggagagcgctgtggatgccagggacgccatcgccaaggtcttgtatgcactgctgttcagctggctcatcaccagggtcaacgcgctggtgtccccaaggcaggacacactgtccatcgccatcctggacatctatggtttcgaggacctgagcttcaacagctttgagcagctgtgtattaactacgcaaacgagaaccttcagtaccttttcaacaagatcgtcttccaggaggagcaggaggagtacatccgtgagcagatagactggcaggagatcacctttgctgacaaccagccctgcatcaacctcatctcactgaagccttatggcatcctgcggatccttgacgaccagtgttgctttccccaggctacagaccacaccttcctacagaagtgccactaccatcatggcgccaacccgctctattccaaacccaagatgccgctgcctgagttcaccatcaagcactatgcaggcaaggtcacctaccaggtgcacaagttcctggacaagaaccacgaccaagtgcgccaggatgtgctggacctgttcgtacggagccggacacgggtggtggcacacctcttctccagccatgccccacaggctgcccctcagcgcctgggcaagagcagctccgtcactcggctctacaaggcgcacactgtggccgccaagttccagcagtcactcctggatctggtggaaaagatggagaggtgcaaccccttgttcatgcgttgcctgaagcccaaccacaagaaggagccaggtctctttgagccagatgtggtaatggcacaattacgctattcaggggtgctggagaccgtgaggatccgcaaggagggatttccagtgcgcctgcctttccaggggttcatcgacaggtactgctgtctagtggccctcaagcatgacctgccggctaatggggacatgtgtgtgtcagtgctgagtcgcctgtgcaaagtcatgccaaacatgtaccgtgttggggtcagcaagctgttccttaaggaacacctataccagctgctggagagtatgcgagagcatgtcctgaatctggcagccctcactctgcagcgctgcctccgtggcttcttcattaagcggcgattccgctctctgcgccacaagatcatcctgctgcaaagccgggcccgtggctaccttgccaggcaacgctatcagcagatgaggaggagtctggtgaagttccggtccctggtacacgcatacgtgagccgccgacgctatctcaagctgagggcagagtggaggtgccaggtggagggggcgctgctgtgggagcaggaggagctgagcaagcgggaggtagtcgctgtggggcacctggaggtaccggctgagctggctgggctcttgcaagcagtggcaggcctcgggctggcccaggtgcctcaggtggcccctgtgaggactcctcgactccaggctgagccccgtgtcacactgcccctggacatcaacaactatcctatggccaagtttgtccagtgccacttcaaggaacctgcctttgggatgctgacagtgcccctgaggacacccctcacgcagctgccagccgagcaccatgcagaagccgtgagcatcttcaagctgatcctgcgcttcatgggcgacccccacctgcatggtgcccgggagaacatcttcgggaactacatcgtgcagaaggggctggcggtgcctgagctgcgggatgagatcctggcacagctggccaatcaggtgtggcacaatcacaatgcccacaatgctgagcggggctggctgctgctggccgcctgcctcagtggctttgcaccttccccgtgcttcaacaagtaccttctcaagtttgtgtctgattatgggcggaatggcttccaggctgtgtgtcagcaccgcctcatgcaggccatgggccgggcccaacagcagggctcgggggctgcccgcaccttacccccgacccagctcgagtggacagcgacctatgagaaggccagcatggcgctggacgtgggctgcttcaatggtgaccagttctcctgcccggtgcactcctggagtacgggggaagaggtggctggagacattctgaggcacagggggctggcagatggctggcgcggctggaccgtggccatgaagaatggtgtccagtgggcagagctggctggccacgactacgtgttagacctggtgtcggacctggagctgctcagggacttccctcgacagaagtcctacttcattgtgggcacagaggggcctgcagccagcaggggaggccccaaagtggtgtttgggaacagctgggactcggatgaggacatgtccactagaccccagccccaggagcacatgcccaaagtacttgactctgatgggtacagcagccacaatcaggacggtacaaatggggagactgaggcccaaagagggacagcaacccaccaagagtcagacagtcttggagagcctgctgtgccccacaaggggctggactgctacctggatagcctctttgaccctgtgctgtcctacggggatgcggacctggagaagccaacagccattgcctaccgcatgaaagggggaggccagcccggtggaggcagcagtagtggtactgaagacacccccaggagacccccagagccaaagccaatcccaggcctggatgcctccacattggctctgcagcaagccttcatccacaaacaggccgtgctgctggcccgggagatgaccctgcaggccacggcactccagcagcagcccctgagtgctgccctgagatccttgcccgcagagaaacccccagcaccagaggcacagccgacgtctgtaggcaccggtccccctgccaaacccgtgctcctgcgtgccactccaaagcccttggccccagcccctctggccaaggctccaaggctccccatcaagcctgtggctgcccctgttctagctcaggatcaggcttctccagaaaccacttcaccctccccagagctggtccggtactctacgctcaactctgagcacttcccacagcccacacagcagatcaagaatattgtcaggcagtaccagcagccgttccggggaggccggcctgaggccctcaggaaggatggcgggaaagtgttcatgaagcggccagaccctcatgaggaggccctgatgatcctgaaagggcagatgacccacctggcagctgcacctggcacccaggtgtccagagaggccgtggccctggtgaagccggtgaccagtgcaccaaggccatccatggcacccacttcagctctgccctcgcgatcgctggagccccctgaggaactcacgcagacgcggctgcaccgcctcatcaatcccaacttctacggctatcaggacgccccctggaagatcttcctgcgcaaagaggtgttttaccccaaggacagctacagccatcctgtgcagcttgacctcctgttccggcagatcctgcacgacacgctctccgaggcctgccttcgcatctctgaggatgagaggctcaggatgaaggccttgtttgcccagaaccagctggacacacagaagcctctggtaacggaaagcgtgaagcgggccgtggtcagcactgcacgagacacctgggaggtctacttctcccgcatcttccccgccacgggcagcgtgggcactggtgtgcagctcctagctgtgtcccacgtgggcatcaaactcctgaggatggtcaagggtggccaggaggccggcgggcagctgcgggtcctgcgtgcatacagctttgcagatatcctgtttgtgaccatgccctcccagaacatgctggagttcaacctggccagtgagaaggtcatcctcttctcagcccgagcgcaccaggtcaagaccctggtagatgacttcatcttggagctgaagaaggactctgactacgtggtcgctgtgaggaacttcctgcctgaggaccctgcgctgctggctttccacaagggtgacatcatacacctgcagcccctagagccacctcgagtgggctacagtgctggctgcgtggttcgcaggaaggtggtgtacctggaggagctgcgacgtagaggccccgactttggctggaggttcgggaccatccacgggcgcgtgggccgcttcccttcggagctggtgcagcccgctgctgcccccgacttcctgcagctgccaacggagccaggccgcggccgagcagccgccgtggccgctgctgtggcctctgcagccgctgcacaggaggtgggccgcaggagagagggtcccccagtcagggcccgctctgctgaccatggggaggacgccctggcgctcccaccctacacaatgctcgagtttgcccagaagtatttccgagaccctcagaggagaccccaggatggcctcaggctgaaatccaaggagcctcgggagtccagaaccttggaggacatgctttgcttcaccaagactcccctccaggaatccctcatcgaactcagcgacagcagcctcagcaagatggccaccgacatgttcctagctgtaatgaggttcatgggggatgccccactgaagggccagagtgacctggacgtgctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggccagcatgtgtgcccactcagtcgccgtgcttacatcctggatgtggcctcagagatggagcaggtggacggcggctacatgctctggttccggcgtgtgctctgggatcagccactcaagttcgagaatgagctatatgtgaccatgcactacaaccaggtcctgcctgactacctgaagggactcttcagcagtgtgccggccagccggcccagcgagcagctgctgcagcaggtgtccaagctggcttcactgcagcatcgcgccaaggaccacttctacctgccgagcgtgcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgaattgatggtgaagttccccctgaaggagatccagtcgacgcggacccagcggcccacggccaactccagctacccctatgtggagattgcgctgggggacgtggcggcccagcgcaccttgcagctgcagctggagcagggactggaactgtgtcgtgtggtggccgtgcacgtggagaacctgctcagtgcccatgagaagcggctcacattgccccccagcgagatcaccctgctctga

SEQ ID NO: 38 - protein, 3530 aa, Homo sapiens
MAKEEDEEKKAKKGKKGKKAPEPEKPKRSLKGTSRLFMGFRDRTPKISKKGQFRSASAFFWGLHTGPQKTKRKRKARTVLKSTSKLMTQMRMGKKKRAMKGKKPSFMVIRFPGRRGYGRLRPRARSLSKASTAINWLTKKFLLKKAEESGSEQATVDAWLQRSSSRMGSRKLPFPSGAEILRPGGRLRRFPRSRSIYASGEPLGFLPFEDEAPFHHSGSRKSLYGLEGFQDLGEYYDYHRDGDDYYDRQSLHRYEEQEPYLAGLGPYSPAWPPYGDHYYGYPPEDPYDYYHPDYYGGPFDPGYTYGYGYDDYEPPYAPPSGYSSPYSYHDGYEGEAHPYGYYLDPYAPYDAPYPPYDLPYHTPYDVPYFDPYGVHYTVPYAEGVYGGGDEAIYPPEVPYFYPEESASAFVYPWVPPPIPSPHNPYAHAMDDIAELEEPEDAGVERQGTSFRLPSAAFFEQQGMDKPARSKLSLIRKFRLFPRPQVKLFGKEKLEVPLPPSLDIPLPLGDADEEEDEEELPPVSAVPYGHPFWGFLTPRQRNLQRALSAFGAHRGLGFGPEFGRPVPRPATSLARFLKKTLSEKKPIARLRGSQKARAGGPAVREAAYKRFGYKLAGMDPEKPGTPIVLRRAQPRARSSNDARRPPAPQPAPRTLSHWSALLSPPVPPRPPSSGPPPAPPLSPALSGLPRPASPYGSLRRHPPPWAAPAHVPPAPQASWWAFVEPPAVSPEVPPDLLAFPGPRPSFRGSRRRGAAFGFPGASPRASRRRAWSPLASPQPSLRSSPGLGYCSPLAPPSPQLSLRTGPFQPPFLPPARRPRSLQESPAPRRAAGRLGPPGSPLPGSPRPPSPPLGLCHSPRRSSLNLPSRLPHTWRRLSEPPTRAVKPQVRLPFHRPPRAGAWRAPLEHRESPREPEDSETPWTVPPLAPSWDVDMPPTQRPPSPWPGGAGSRRGFSRPPPVPENPFLQLLGPVPSPTLQPEDPAADMTRVFLGRHHEPGPGQLTKSAGPTPEKPEEEATLGDPQLPAETKPPTPAPPKDVTPPKDITPPKDVLPEQKTLRPSLSYPLAACDQTRATWPPWHRWGTLPQAAAPLAPIRAPEPLPKGGERRQAAPGRFAVVMPRVQKLSSFQRVGPATLKPQVQPIQDPKPRACSLRWSCLWLRADAYGPWPRVHTHPQSCHLGPGAACLSLRGSWEEVGPPSWRNKMHSIRNLPSMRFREQHGEDGVEDMTQLEDLQETTVLSNLKIRFERNLIYTYIGSILVSVNPYQMFGIYGPEQVQQYNGRALGENPPHLFAVANLAFAKMLDAKQNQCIIISGESGSGKTEATKLILRYLAAMNQKREVMQQIKILEATPLLESFGNAKTVRNDNSSRFGKFVEIFLEGGVISGAITSQYLLEKSRIVFQAKNERNYHIFYELLAGLPAQLRQAFSLQEAETYYYLNQGGNCEIAGKSDADDFRRLLAAMEVLGFSSEDQDSIFRILASILHLGNVYFEKYETDAQEVASVVSAREIQAVAELLQISPEGLQKAITFKVTETMREKIFTPLTVESAVDARDAIAKVLYALLFSWLITRVNALVSPRQDTLSIAILDIYGFEDLSFNSFEQLCINYANENLQYLFNKIVFQEEQEEYIREQIDWQEITFADNQPCINLISLKPYGILRILDDQCCFPQATDHTFLQKCHYHHGANPLYSKPKMPLPEFTIKHYAGKVTYQVHKFLDKNHDQVRQDVLDLFVRSRTRVVAHLFSSHAPQAAPQRLGKSSSVTRLYKAHTVAAKFQQSLLDLVEKMERCNPLFMRCLKPNHKKEPGLFEPDVVMAQLRYSGVLETVRIRKEGFPVRLPFQGFIDRYCCLVALKHDLPANGDMCVSVLSRLCKVMPNMYRVGVSKLFLKEHLYQLLESMREHVLNLAALTLQRCLRGFFIKRRFRSLRHKIILLQSRARGYLARQRYQQMRRSLVKFRSLVHAYVSRRRYLKLRAEWRCQVEGALLWEQEELSKREVVAVGHLEVPAELAGLLQAVAGLGLAQVPQVAPVRTPRLQAEPRVTLPLDINNYPMAKFVQCHFKEPAFGMLTVPLRTPLTQLPAEHHAEAVSIFKLILRFMGDPHLHGARENIFGNYIVQKGLAVPELRDEILAQLANQVWHNHNAHNAERGWLLLAACLSGFAPSPCFNKYLLKFVSDYGRNGFQAVCQHRLMQAMGRAQQQGSGAARTLPPTQLEWTATYEKASMALDVGCFNGDQFSCPVHSWSTGEEVAGDILRHRGLADGWRGWTVAMKNGVQWAELAGHDYVLDLVSDLELLRDFPRQKSYFIVGTEGPAASRGGPKVVFGNSWDSDEDMSTRPQPQEHMPKVLDSDGYSSHNQDGTNGETEAQRGTATHQESDSLGEPAVPHKGLDCYLDSLFDPVLSYGDADLEKPTAIAYRMKGGGQPGGGSSSGTEDTPRRPPEPKPIPGLDASTLALQQAFIHKQAVLLAREMTLQATALQQQPLSAALRSLPAEKPPAPEAQPTSVGTGPPAKPVLLRATPKPLAPAPLAKAPRLPIKPVAAPVLAQDQASPETTSPSPELVRYSTLNSEHFPQPTQQIKNIVRQYQQPFRGGRPEALRKDGGKVFMKRPDPHEEALMILKGQMTHLAAAPGTQVSREAVALVKPVTSAPRPSMAPTSALPSRSLEPPEELTQTRLHRLINPNFYGYQDAPWKIFLRKEVFYPKDSYSHPVQLDLLFRQILHDTLSEACLRISEDERLRMKALFAQNQLDTQKPLVTESVKRAVVSTARDTWEVYFSRIFPATGSVGTGVQLLAVSHVGIKLLRMVKGGQEAGGQLRVLRAYSFADILFVTMPSQNMLEFNLASEKVILFSARAHQVKTLVDDFILELKKDSDYVVAVRNFLPEDPALLAFHKGDIIHLQPLEPPRVGYSAGCVVRRKVVYLEELRRRGPDFGWRFGTIHGRVGRFPSELVQPAAAPDFLQLPTEPGRGRAAAVAAAVASAAAAQEVGRRREGPPVRARSADHGEDALALPPYTMLEFAQKYFRDPQRRPQDGLRLKSKEPRESRTLEDMLCFTKTPLQESLIELSDSSLSKMATDMFLAVMRFMGDAPLKGQSDLDVLCNLLKLCGDHEVMRDECYCQVVKQITDNTSSKQDSCQRGWRLLYIVTAYHSCSEVLHPHLTRFLQDVSRTPGLPFQGIAKACEQNLQKTLRFGGRLELPSSIELRAMLAGRSSKRQLFLLPGGLERHLKIKTCTVALDVVEEICAEMALTRPEAFNEYVIFVVTNRGQHVCPLSRRAYILDVASEMEQVDGGYMLWFRRVLWDQPLKFENELYVTMHYNQVLPDYLKGLFSSVPASRPSEQLLQQVSKLASLQHRAKDHFYLPSVREVQEYIPAQLYRTTAGSTWLNLVSQHRQQTQALSPHQARAQFLGLLSALPMFGSSFFFIQSCSNIAVPAPCILAINHNGLNFLSTETHELMVKFPLKEIQSTRTQRPTANSSYPYVEIALGDVAAQRTLQLQLEQGLELCRVVAVHVENLLSAHEKRLTLPPSEITLL

SEQ ID NO: 39 - DNA, 9177 bp, Homo sapiens
atgggcaggaaccagcgcaaagcgccccagcgcctggagaggcccgggaggccggcctcaggggagcaggagtcggggtcggccagcgcggatggcgcgcccagccgggaacgccgttccgaccgcgggcaggcggacagggcgaaaccggcggccgagcctgccaccgccgggggccagggaacccctggtggccgcaggaagcccactgcagaggggaacggcggctgcagacgcccaggggctgggctgtccccgaaagcccaggagaggcaaagcaacgcgcagcgtcagggacgcgggcccaggggcggccgcggggggcgcctggaggagggaagcctctccggaggagaagagctgggcggccgccgtaggaggaagcggaaagataaggggccctcggctcggcggggccgccggacgcccaggagcctcaatggggacacgtcgggtggggacggaggcagctcctgtccggacagcgaaacccgcgaggcccaggagagcggcagccagcgcggcacagcccgggagctgcggcccacgccggagcctacggacatgggctcggaagggacaaaaaccgggccggagtcagcgctggagccaagcagcgacggcctggacagcgactggccccacgcagatacccggggccgggaagggtcgtcggggacggggcccctgggagccagcgagcattccggcggggactccgactcgagtccgctggggaccggacctggacggggctctcgggcagctatggcctccaggaccttcgaggacagctcgcgggctcctcgggacactgggccggccaaggacgcgagcgacaaccgggcgcagcggggcgccgagccagaaacaatgcaggcctcgacggcccgggctccgcgccaccaggtcggaaaggcggtggggcaggtgccagcggcggcaggcgagggcgaagcgggagccgcagcaggagcggggccggaggacccagccccgctggcggccctcctggtggtccgcaggctcctcgcgaggcccccgccaggcgccgcttcccaggccgtgggcccccgccgcgctggcctcaaggagcggctcctgagtgtagcgcgagccctgggcctcctgcgctggctgcggcggcggctgcggctgcggcggcggccgccagagggcgaggggcagggtaccgggccacgggcgagcgaggggtggggccgccggaaaccggacgaggggcggggtcatgggagaggaagcaaggggcggggccgcgggaaagcggatgaagggcggggccacgagcgaggggacgagggtcggggccgcgggaaagcggacgaagggcggggccacgagcgagggtacgaggggcggggctgcgggaaagcggacgaggggcggggtcacgagagaggtgacgagggccgggaccaccagagagggtacgaggggtggggccgtgagcccgggctgcggcaccgtctagcgttgcgcctggctggcttagcagggctggggggtatgccgagggcttcccctggtggccgctccccgcaggtcccgacaagcccagtccccggcgacccttttgatcaggaggacgagactccagatcccaagttcgcggtcgtgttccccaggatccacagggcagggcgggcgtcgagcagccgcagctctgaagaagcgtccgcagatgcccccacgggggaaggccgaggttggcctcgtgcaggggtgggggggcacagtgaggggtgcaggacgagtggggaaggggtgtccgggcttcgtcgcggctccctccttgccccgactgcacccgacgggccttccctcgacgagagcggctccagcagtgaggcggagttggagaccctcaatgacgagcccccggtgcgctgggcgcagggctcaggcccccacgagggtcctaggcttggcgccgccgtgctgctaccccgactctccttggagacccgcctgcagcaggagggagacccgggcctccgtgggtccctgagggagctgtgggaacccgaggatgaggacgaggcggtgctggagagggacctggagctgagcctccggccgggcctggaggcgccacccttccccggtgccaagggcaggagcctcggagacggcctggaagacatggaggacctggcgcggttgcggctggtgtgtgacagctctgtgctgctgtgcctcaagaagagatttcacctgggccgtatctatacctttggggggcctgtcttgcttgttctgaacccccaccggtccttgcctcttttttcacctgaggtccaggcaagctaccaccccaggaaggccctcagcaccactccacacatctttgccatcgtggcatcagcctatgacctggctcagaatactgggcaggacccatgcatcctcctgtgctcctcccactgcagtgggcacagtggctcagggaagacggaagccgccaaaaagatcatgcagttcctaagcagcctggagcaggatcagacggggaaccgagagtgtcaggtggaggatatgctgcctatactcagcagctttggccatgccaagaccatcctcaatgccaatgccagccgcttcggccaggtcttctgcctctacctacagcaaggggtcatcgtgggagcctctgtgtctcattatctacttgagacctccagggtggtgtttcagggccaggcctgcaggctgcaaggcaaggaggatgcccaggactttgaggggctgctgaaggcactgcaggggctcggcttgtgcccagaggagttgaatgccgtctgggctgtgctggccgccatcctgcagctgggcaacatctgcttctcctcctcagagcgagagtcccaggaggtggctgctgtgtctagctgggctgagatccacacagcagcccgactgctgcgggtaccaccagagtgcctggagggggctgtcaccaggagggtcacggagacgccctatggccaggtctcgcgatccctgcccgtggaaagtgcctttgatgccagggacgccctggccaaggcactgtattcccgcctcttccaccggcttctgaggagaaccaatgcacggctggcaccaccaggggagggaggcagcattggcaccgtcactgtcgtggatgcctacggctttgaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgccggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaagggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactga

SEQ ID NO: 40 - protein, 3058 aa, Homo sapiens
MGRNQRKAPQRLERPGRPASGEQESGSASADGAPSRERRSDRGQADRAKPAAEPATAGGQGTPGGRRKPTAEGNGGCRRPGAGLSPKAQERQSNAQRQGRGPRGGRGGRLEEGSLSGGEELGGRRRRKRKDKGPSARRGRRTPRSLNGDTSGGDGGSSCPDSETREAQESGSQRGTARELRPTPEPTDMGSEGTKTGPESALEPSSDGLDSDWPHADTRGREGSSGTGPLGASEHSGGDSDSSPLGTGPGRGSRAAMASRTFEDSSRAPRDTGPAKDASDNRAQRGAEPETMQASTARAPRHQVGKAVGQVPAAAGEGEAGAAAGAGPEDPAPLAALLVVRRLLARPPPGAASQAVGPRRAGLKERLLSVARALGLLRWLRRRLRLRRRPPEGEGQGTGPRASEGWGRRKPDEGRGHGRGSKGRGRGKADEGRGHERGDEGRGRGKADEGRGHERGYEGRGCGKADEGRGHERGDEGRDHQRGYEGWGREPGLRHRLALRLAGLAGLGGMPRASPGGRSPQVPTSPVPGDPFDQEDETPDPKFAVVFPRIHRAGRASSSRSSEEASADAPTGEGRGWPRAGVGGHSEGCRTSGEGVSGLRRGSLLAPTAPDGPSLDESGSSSEAELETLNDEPPVRWAQGSGPHEGPRLGAAVLLPRLSLETRLQQEGDPGLRGSLRELWEPEDEDEAVLERDLELSLRPGLEAPPFPGAKGRSLGDGLEDMEDLARLRLVCDSSVLLCLKKRFHLGRIYTFGGPVLLVLNPHRSLPLFSPEVQASYHPRKALSTTPHIFAIVASAYDLAQNTGQDPCILLCSSHCSGHSGSGKTEAAKKIMQFLSSLEQDQTGNRECQVEDMLPILSSFGHAKTILNANASRFGQVFCLYLQQGVIVGASVSHYLLETSRVVFQGQACRLQGKEDAQDFEGLLKALQGLGLCPEELNAVWAVLAAILQLGNICFSSSERESQEVAAVSSWAEIHTAARLLRVPPECLEGAVTRRVTETPYGQVSRSLPVESAFDARDALAKALYSRLFHRLLRRTNARLAPPGEGGSIGTVTVVDAYGFEALRVNGLEQLCNNLASERLQLFSSQMLLAQEEEECRRELLSWVPVPQPPRESCLDLLVDQPHSLLSILDAQTWLSQATDHTFLQKSHYHHGDHPSYAKPRLPLPVFTVRHYAGTVTYQVHKFLNRNRDQLDPAVVEMLGQSQLQLVGSLFQEAEPQSRGGRGRPTLASRFQQALEDLIARLGRSHVYFIQCLTPNPGKLPGLFDVGHVTEQLHQAAILEAVGTRSANFPVRVPFEAFLASFQALGSEGQEDLSDREKCGAVLSQVLGAESPLYHLGATKVLLQEQGWQRLEELRDQQRSQALVDLHRSFHTCISRQRVLPRMQARMRGFQARKRYLRRRAALGQLNTILLVAQPLLQRRQRLQLGRWQGWHSSERALERVPSMELGRLEIPAELAVMLKTAESHRDALAGSITECLPPEVPARPSLTLPADIDLFPFSSFVAIGFQEPSLPRPGQPLAKPLTQLDGDNPQRALDINKVMLRLLGDGSLESWQRQIMGAYLVRQGQCRPGLRNELFSQLVAQLWQNPDEQQSQRGWALMAVLLSAFPPLPVLQKPLLKFVSDQAPRGMAALCQHKLLGALEQSQLASGATRAHPPTQLEWLAGWRRGRMALDVFTFSEECYSAEVESWTTGEQLAGWILQSRGLEAPPRGWSVSLHSRDAWQDLAGCDFVLDLISQTEDLGDPARPRSYPITPLGSAEAIPLAPGIQAPSLPPGPPPGPAPTLPSRDHTGEVQRSGSLDGFLDQIFQPVISSGLSDLEQSWALSSRMKGGGAIGPTQQGYPMVYPGMIQMPAYQPGMVPAPMPMMPAMGTVPAMPAMVVPPQPPLPSLDAGQLAVQQQNFIQQQALILAQQMTAQAMSLSLEQQMQQRQQQARASEAASQASPSAVTSKPRKPPTPPEKPQRDLGSEGGCLRETSEEAEDRPYQPKSFQQKRNYFQRMGQPQITVRTMKPPAKVHIPQGEAQEEEEEEEEEEEQEEQEVETRAVPSPPPPPIVKKPLKQGGAKAPKEAEAEPAKETAAKGHGQGPAQGRGTVVRSSDSKPKRPQPSREIGNIIRMYQSRPGPVPVPVQPSRPPKAFLRKIDPKDEALAKLGINGAHSSPPMLSPSPGKGPPPAVAPRPKAPLQLGPSSSIKEKQGPLLDLFGQKLPIAHTPPPPPAPPLPLPEDPGTLSAERRCLTQPVEDQGVSTQLLAPSGSVCFSYTGTPWKLFLRKEVFYPRENFSHPYYLRLLCEQILRDTFSESCIRISQNERRKMKDLLGGLEVDLDSLTTTEDSVKKRIVVAARDNWANYFSRFFPVSGESGSDVQLLAVSHRGLRLLKVTQGPGLRPDQLKILCSYSFAEVLGVECRGGSTLELSLKSEQLVLHTARARAIEALVELFLNELKKDSGYVIALRSYITDNCSLLSFHRGDLIKLLPVATLEPGWQFGSAGGRSGLFPADIVQPAAAPDFSFSKEQRSGWHKGQLSNGEPGLARWDRASERPAHPWSQAHSDDSEATSLSSVAYAFLPDSHSYTMQEFARRYFRRSQALLGQTDGGAAGKDTDSLVQYTKAPIQESLLSLSDDVSKLAVASFLALMRFMGDQSKPRGKDEMDLLYELLKLCQQEKLRDEIYCQVIKQVTGHPRPEHCTRGWSFLSLLTGFFPPSTRLMPYLTKFLQDSGPSQELARSSQEHLQRTVKYGGRRRMPPPGEMKAFLKGQAIRLLLIHLPGGVDYRTNIQTFTVAAEVQEELCRQMGITEPQEVQEFALFLIKEKSQLVRPLQPAEYLNSVVVDQDVSLHSRRLHWETPLHFDNSTYISTHYSQVLWDYLQGKLPVSAKADAQLARLAALQHLSKANRNTPSGQDLLAYVPKQLQRQVNTASIKNLMGQELRRLEGHSPQEAQISFIEAMSQLPLFGYTVYGVLRVSMQALSGPTLLGLNRQHLILMDPSSQSLYCRIALKSLQRLHLLSPLEEKGPPGLEVNYGSADNPQTIWFELPQAQELLYTTVFLIDSSASCTEWPSIN

SEQ ID NO: 41 - DNA, 1095 bp, Homo sapiens
atggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcactgcatccgtcttcacaaatgggcttgtgctggcggccaccatgaagttcaagaagctgcgccacccgctgaactggatcctggtgaacctggcggtcgctgacctagcagagaccgtcatcgccagcactatcagcattgtgaaccaggtctctggctacttcgtgctgggccaccctatgtgtgtcctggagggctacaccgtctccctgtgtgggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcatcccactcgctatcatcatgctctgctacctccaagtgtggctggccatccgagcggtggcaaagcagcagaaagagtctgaatccacccagaaggcagagaaggaagtgacgcgcatggtggtggtgatgatctttgcgtactgcgtctgctggggaccctacaccttcttcgcatgctttgctgctgccaaccctggttacgccttccaccctttgatggctgccctgccggcctactttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatga

SEQ ID NO: 42 - protein, 364 aa, Homo sapiens
MAQQWSLQRLAGRHPQDSYEDSTQSSIFTYTNSNSTRGPFEGPNYHIAPRWVYHLTSVWMIFVVTASVFTNGLVLAATMKFKKLRHPLNWILVNLAVADLAETVIASTISIVNQVSGYFVLGHPMCVLEGYTVSLCGITGLWSLAIISWERWMVVCKPFGNVRFDAKLAIVGIAFSWIWAAVWTAPPIFGWSRYWPHGLKTSCGPDVFSGSSYPGVQSYMIVLMVTCCIIPLAIIMLCYLQVWLAIRAVAKQQKESESTQKAEKEVTRMVVVMIFAYCVCWGPYTFFACFAAANPGYAFHPLMAALPAYFAKSATIYNPVIYVFMNRQFRNCILQLFGKKVDDGSELSSASKTEVSSVSSVSPA

SEQ ID NO: 43 - DNA, 1095 bp, Homo sapiens
atggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcattgcatccgtcttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtgggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtggcaaagcagcagaaagagtctgaatccacccagaaggcagagaaggaagtgacgcgcatggtggtggtgatggtcctggcattctgcttctgctggggaccatacgccttcttcgcatgctttgctgctgccaaccctggctaccccttccaccctttgatggctgccctgccggccttctttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatga

SEQ ID NO: 44 - protein, 364 aa, Homo sapiens
MAQQWSLQRLAGRHPQDSYEDSTQSSIFTYTNSNSTRGPFEGPNYHIAPRWVYHLTSVWMIFVVIASVFTNGLVLAATMKFKKLRHPLNWILVNLAVADLAETVIASTISVVNQVYGYFVLGHPMCVLEGYTVSLCGITGLWSLAIISWERWMVVCKPFGNVRFDAKLAIVGIAFSWIWAAVWTAPPIFGWSRYWPHGLKTSCGPDVFSGSSYPGVQSYMIVLMVTCCITPLSIIVLCYLQVWLAIRAVAKQQKESESTQKAEKEVTRMVVVMVLAFCFCWGPYAFFACFAAANPGYPFHPLMAALPAFFAKSATIYNPVIYVFMNRQFRNCILQLFGKKVDDGSELSSASKTEVSSVSSVSPA

SEQ ID NO: 45 - DNA, 1047 bp, Homo sapiens
atgagaaaaatgtcggaggaagagttttatctgttcaaaaatatctcttcagtggggccgtgggatgggcctcagtaccacattgcccctgtctgggccttctacctccaggcagctttcatgggcactgtcttccttatagggttcccactcaatgccatggtgctggtggccacactgcgctacaaaaagttgcggcagcccctcaactacattctggtcaacgtgtccttcggaggcttcctcctctgcatcttctctgtcttccctgtcttcgtcgccagctgtaacggatacttcgtcttcggtcgccatgtttgtgctttggagggcttcctgggcactgtagcaggtctggttacaggatggtcactggccttcctggcctttgagcgctacattgtcatctgtaagcccttcggcaacttccgcttcagctccaagcatgcactgacggtggtcctggctacctggaccattggtattggcgtctccatcccacccttctttggctggagccggttcatccctgagggcctgcagtgttcctgtggccctgactggtacaccgtgggcaccaaataccgcagcgagtcctatacgtggttcctcttcatcttctgcttcattgtgcctctctccctcatctgcttctcctacactcagctgctgagggccctgaaagctgttgcagctcagcagcaggagtcagctacgacccagaaggctgaacgggaggtgagccgcatggtggttgtgatggtaggatccttctgtgtctgctacgtgccctacgcggccttcgccatgtacatggtcaacaaccgtaaccatgggctggacttacggcttgtcaccattccttcattcttctccaagagtgcttgcatctacaatcccatcatctactgcttcatgaataagcagttccaagcttgcatcatgaagatggtgtgtgggaaggccatgacagatgaatccgacacatgcagctcccagaaaacagaagtttctactgtctcgtctacccaagttggccccaactga

SEQ ID NO: 46 - protein, 348 aa, Homo sapiens
MRKMSEEEFYLFKNISSVGPWDGPQYHIAPVWAFYLQAAFMGTVFLIGFPLNAMVLVATLRYKKLRQPLNYILVNVSFGGFLLCIFSVFPVFVASCNGYFVFGRHVCALEGFLGTVAGLVTGWSLAFLAFERYIVICKPFGNFRFSSKHALTVVLATWTIGIGVSIPPFFGWSRFIPEGLQCSCGPDWYTVGTKYRSESYTWFLFIFCFIVPLSLICFSYTQLLRALKAVAAQQQESATTQKAEREVSRMVVVMVGSFCVCYVPYAAFAMYMVNNRNHGLDLRLVTIPSFFSKSACIYNPIIYCFMNKQFQACIMKMVCGKAMTDESDTCSSQKTEVSTVSSTQVGPN

SEQ ID NO: 47 - DNA, 1047 bp, Homo sapiens
atgaatggcacagaaggccctaacttctacgtgcccttctccaatgcgacgggtgtggtacgcagccccttcgagtacccacagtactacctggctgagccatggcagttctccatgctggccgcctacatgtttctgctgatcgtgctgggcttccccatcaacttcctcacgctctacgtcaccgtccagcacaagaagctgcgcacgcctctcaactacatcctgctcaacctagccgtggctgacctcttcatggtcctaggtggcttcaccagcaccctctacacctctctgcatggatacttcgtcttcgggcccacaggatgcaatttggagggcttctttgccaccctgggcggtgaaattgccctgtggtccttggtggtcctggccatcgagcggtacgtggtggtgtgtaagcccatgagcaacttccgcttcggggagaaccatgccatcatgggcgttgccttcacctgggtcatggcgctggcctgcgccgcacccccactcgccggctggtccaggtacatccccgagggcctgcagtgctcgtgtggaatcgactactacacgctcaagccggaggtcaacaacgagtcttttgtcatctacatgttcgtggtccacttcaccatccccatgattatcatctttttctgctatgggcagctcgtcttcaccgtcaaggaggccgctgcccagcagcaggagtcagccaccacacagaaggcagagaaggaggtcacccgcatggtcatcatcatggtcatcgctttcctgatctgctgggtgccctacgccagcgtggcattctacatcttcacccaccagggctccaacttcggtcccatcttcatgaccatcccagcgttctttgccaagagcgccgccatctacaaccctgtcatctatatcatgatgaacaagcagttccggaactgcatgctcaccaccatctgctgcggcaagaacccactgggtgacgatgaggcctctgctaccgtgtccaagacggagacgagccaggtggccccggcctaa

SEQ ID NO: 48 - protein, 348 aa, Homo sapiens [sequence omitted]

SEQ ID NO: 49 - DNA, 15609 bp, Homo sapiens
atgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgcatcagacaaaaatcagcttctttatcaatggcgtggagaaggatcatacacctttcaatgcaagaactctaagtggttcaattacagattttgcatctggtactgtgcaaataggacagagtttaaatggtttagagcagtttgtcggaagaatgcaagattttcgattataccaagtggcacttacaaacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaattttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggagatgtcagtgccatggtcatgccgataactgcgacacaacaagccagccatatagatgcctctgctcccaggagagcttcactgaaggacttcattgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggaaggaactgtgagctgtgcaaggattactttttccgacaagttggtgcagatccttcggccatagatgtttgcaaaccctgtgactgtgatacagttggcactagaaatggtagcattctttgtgatcagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattgggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaactccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacagctgttgcacactgctaaatcccaagaactatcttacactgtagaaggactgaaaccttataggatatatgagtttactattactctctgcaattcagttggttgtgtgaccagtgcttcgggagcaggacaaactttagcagcagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggcattaaggccagctttcgaacaaaagtgcctgaaggtttgattgtctttgcagcatcacctggcaatcaggaagagtattttgcacttcagttgaagaagggacgtctttattttctttttgatcctcaggggtcaccagtggaagtaactacaactaatgatcatggcaaacaatatagtgatggaaaatggcatgaaataattgctattaggcatcaggcttttggccaaatcactctggatgggatatatacaggttcctctgccatcctgaatggtagtactgttattggagataacacaggagtctttctgggagggctcccgcgaagttataccatcctcaggaaggatcctgagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcagggttcctggaacttcatccatatatgtttcatggtggaatgaactttgagatttcctttaagttcagaactgaccaattaaatggattgcttcttttcgtttataacaaagatggacctgattttcttgctatggagctgaaaagtggaatattgaccttccggttaaataccagtcttgcctttacacaagtggatctattgctggggctatcctattgtaatggaaagtggaataaagtcattattaaaaaggaaggctctttcatatcagcaagtgtgaatggactgatgaagcatgcatcggagtccggagaccagccactggtggtgaattcaccagtttatgtgggaggaatcccacaggaactgctgaactcttatcaacatttgtgtttggaacaaggtttcggtggttgcatgaaggatgttaaatttacacggggtgctgtcgttaacttggcatctgtgtccagcggtgctgtcagagtcaatctggatggatgcctatcaactgacagtgctgttaactgcaggggaaatgactccatcctggtttaccagggaaaagagcagagtgtttacgagggtggtctccagccttttacagaatacctgtatcgagtgatagcctcgcatgaaggaggttcagtatatagtgattggagtcgaggacgtacaacaggagcagctccacaaagtgtgccaactccctcaagagtccgcagcttaaatggatacagcattgaggtgacctgggatgaacctgttgtcagaggtgtaattgagaagtacattctgaaagcctatagtgaggacagcacccgtccaccccgcatgccctctgccagtgctgaatttgtcaatacaagcaacctcacaggcatattgacaggcttgctacccttcaaaaactatgcagtaaccctaactgcttgcactttggctggctgtactgagagctcacatgcattgaacatctctactccacaagaagccccacaagaggttcagccaccagtagccaaatcccttcccagttctttgctgctctcctggaacccacccaaaaaggcaaatggtattataactcagtactgtttatacatggatgggaggctgatctattcaggcagtgaggagaactacatagtcacagatttagcagtatttacaccccaccagtttctactaagtgcatgcacacatgtgggctgtacaaacagttcctgggtcctactgtacacagcacagctgccaccagaacacgtggattccccagttctgactgtcctggattctagaactatacacatacagtggaaacaaccaagaaaaataagtgggattctggaacgctatgtattatatatgtcaaaccatacacatgattttacaatttggagtgtcatctataacagtacagaacttttccaggatcatatgctacaatacgttttacctggtaataaatatctcatcaagctgggagcttgcacaggtggtgggtgcacagtgagtgaggccagtgaggccctaactgacgaggacatacccgaaggcgtgccagcccccaaagcccactcatattcacctgactcctttaatgtctcctggactgagcctgaatatccgaatggtgttatcacgagttatggattatatctagatggtatattaatccacaattcctcagaactcagctatcgtgcttacggatttgctccttggagtttacattccttcagagtccaagcatgcacggccaaaggttgtgctctgggcccactggtggaaaatcgaactctagaagctcctcctgaaggaacagtaaatgtgtttgtcaaaacacagggatcccggaaagcccacgtgaggtgggaagcaccttttcgccctaatggactcttaacacactcagtccttttcactgggatattctatgtagacccagtaggtaataactacacccttctgaatgtcacaaaagtcatgtacagcggagaagagacaaacctttgggtgctcatcgatgggctggttccttttaccaactatactgtacaagtgaatatttcaaatagccaaggcagcttgataactgatcctataacaattgcaatgcctccaggagctccagatggcgtgctgcctcccaggctttcatctgccactccaaccagtcttcaggttgtctggtctacaccagctcgtaataacgctcctggctctcccagataccaactccagatgaggtctggcgactccacccatggatttctagagttattttccaatccttctgcatcgttaagctatgaagtgagtgatctccaaccgtacacagagtatatgtttcggttggttgcctccaatggatttggcagtgcacatagttcttggattccattcatgaccgcagaggacaaacctggacctgtagttcctccgattcttctggatgtgaagtcaagaatgatgttggtcacctggcagcatcctagaaaatccaatggggttattacccattataacatttatctacatggccgtctatacttgagaactcctggaaatgtcactaattgcacagtgatgcatttacacccatacactgcctataagtttcaggtagaagcctgcacttcaaaaggatgttccctttcaccagagtcccagactgtatggacactcccaggggcaccggaagggatcccaagtccagagctgttctctgatactccaacatctgtgattatatcttggcaaccccctacccaccccaatggcttggtggagaatttcacaattgagagaagagtcaaaggaaaggaagaagttactaccctggtgactctcccgaggagtcattccatgaggtttattgacaagacttctgctcttagcccatggacaaaatatgaatatcgggtactgatgagcactcttcatggaggcacaaacagcagtgcttgggtagaagttaccacaagaccctcacgacctgctggggtgcagccacctgtggtgacagtgctggaacccgatgcagtccaggtcacttggaaacccccactcatccagaacggagacatacttagctatgagattcacatgcctgaccctcacatcactttaaccaatgtgacttccgcagtgttaagtcaaaaagttactcatctgattcctttcactaattattctgtcaccattgttgcttgctcagggggtaatgggtaccttggagggtgcacagagagtttacctacctatgttaccactcaccccaccgtacctcagaatgttggcccattgtctgtgattccactaagtgaatcatatgttgtgatttcttggcaaccaccatccaagccaaatggacctaatttgagatatgagcttctgagacgtaaaatccagcagccacttgcatcaaatcccccagaagatttaaatcggtggcacaatatttattcaggaactcagtggctttatgaagataagggtcttagcaggtttacaacctatgaatatatgctcttcgtacacaacagtgtgggttttacaccgagccgagaagtgactgtgacaacgttagctggtcttccagagagaggagccaatctcactgcgagtgtccttaaccacacagccatcgacgtgaggtgggctaaaccaactgttcaagacctacaaggtgaagttgaatattacacacttttttggagttctgctacctcaaacgactctctaaaaatcttgccagatgtaaactctcatgtcattggccacctaaagccaaacacagagtattggatctttatctctgtcttcaatggagtccacagcatcaacagtgcaggacttcatgcaaccacttgcgatggggagcctcagggcatgcttcctccagaggttgtcatcatcaacagtacagctgtacgtgtcatctggacatctccttcaaacccaaatggtgttgtcactgagtattctatctatgtaaataataagctctacaagactggaatgaatgtgcctgggtcgtttattctgagagacctgtctcccttcactatctatgacattcaggttgaagtctgcacaatatatgcctgcgtgaaaagcaatggaacccaaattaccactgtggaagacactccaagtgatataccaacacccacaattcgtggcatcacttcaagatctcttcaaattgattgggtgtctccacggaagccaaatggcatcattcttggatatgatctcctatggaaaacatggtatccatgcgctaaaactcaaaagttagtgcaggatcagagtgatgagctctgcaaggcagtgaggtgtcaaaaacctgaatctatctgtggacacatttgctattcttctgaagctaaggtttgttgtaacggagtgctctataaccccaagcctggacatcgctgttgtgaagaaaagtatatcccgtttgttctgaattctactggagtttgttgtggtggccgaatacaggaggcacaaccaaatcatcagtgctgctctgggtattacgctagaattctaccaggtgaagtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccaggtatgttctgttgtgggcaggattatgtgaatatgtcagataccatatgctgctcagcttccagtggagagtctaaagcacatattaaaaagaatgacccggtgccagtaaaatgctgtgagactgaacttattccaaagagccagaaatgctgtaatggagttggatataatcctttgaaatatgtttgctctgacaagatttcaactggaatgatgatgaaggaaaccaaagagtgcaggatcctctgcccagcatctatggaagccacagaacattgtggcaggtgtgacttcaactttaccagccacatttgcactgtgataagagggtctcacaattccacagggaaggcatcaattgaagaaatgtgttcatctgccgaagaaaccattcatacagggagtgtaaacacgtactcttacacagatgtgaacctcaagccctacatgacatatgagtacaggatttctgcctggaacagctatgggcgaggactcagcaaagctgtgagagccagaacaaaagaagatgtgcctcaaggagtgagtccccctacgtggaccaaaatagacaatcttgaagatacaattgtcttaaactggagaaaacctatacaatcaaatggtcctattatttactacatccttcttcgaaatggaattgaacgttttcggggaacatcactgagcttctctgataaagagggaattcaaccatttcaggaatattcatatcagctgaaagcttgcacggttgctggctgtgccaccagtagcaaggtagttgcagctactacccaaggagttccggagagcatcctgccaccaagcatcacagccctaagtgcagtggctctgcatctgagctggagtgtccctgagaaatcaaacggcgtcattaaagagtaccagatcaggcaggttgggaaaggtctcatccacactgacaccactgacaggagacagcatacggtcacaggtctccagccatacaccaactacagcttcactcttacagcttgtacatctgctgggtgcacttcaagcgagccttttctaggtcagacactgcaggcagctcctgaaggagtttgggtgacacctcgacacattatcatcaattctacaacagtggaattatattggagtctgccagaaaagcccaatggcctcgtttctcaatatcaattgagtcgtaatggaaacttgcttttcctgggtggcagtgaggagcagaatttcactgataaaaacctggagcccaatagcagatacacttacaagttagaagtcaaaactggaggtggcagcagtgctagtgatgattacattgttcaaacacctatgtcaacaccagaagaaatctatcctccatataatatcacagtaattgggccttattctatatttgtagcttggataccaccagggatcctcatccccgaaattcctgtggagtacaatgtcttactcaatgatggaagtgtaacacctctggccttctccgttggtcatcatcaatccacccttctggaaaatttgactccattcacacagtatgagataaggatacaagcatgtcaaaatggaagttgtggagttagcagtaggatgtttgtcaaaacacctgaagcagccccaatggatcttaattctcctgttcttaaggcactggggtcagcttgcatagagattaagtggatgccacctgaaaaaccaaatggaatcatcatcaactactttatttacagacgccctgctggcattgaagaggagtctgttttatttgtctggtcagaaggagcccttgaatttatggatgaaggagacaccctgaggcctttcacactctacgaatatcgggtcagagcctgtaactccaagggttcagtggagagtctgtggtcattaacacaaactctggaagctccacctcaagattttccagctccttgggctcaagccacgagtgctcattcagttctgttgaattggacaaagccagaatctcccaatggcattatctcccattaccgtgtggtctaccaggagagacccgacgatcctacatttaacagccctaccgtgcatgctttcacagtgaagggaacaagccatcaagcccacctgtacgggttagaaccattcacaacatatcgcattggtgttgtggctgcaaaccatgcaggagaaattttaagcccttggactctgattcaaaccttagaatcttccccaagtggactgagaaactttatagtagaacagaaagagaatggccgggcattgctactacagtggtcagaacctatgagaaccaatggtgtgattaagacatacaacatcttcagtgacgggttcctggagtactctggtttgaatcgtcagtttctcttccgccgcctggatcctttcactctctacacactgaccctggaggcctgcaccagagcaggttgtgcacactcggcgcctcagcctctgtggacagatgaagcccctccagactctcagctggctcctactgtccactctgtgaagtccaccagtgttgagctgagctggtctgagcctgttaacccaaatggaaaaataattcgctatgaagtgattcgcagatgcttcgagggaaaagcttggggaaatcagacaatccaggccgacgagaaaattgttttcacagaatataacactgaaaggaatacatttatgtataatgacacaggtttgcaaccatggacgcagtgtgaatataaaatctacacttggaattcagctgggcatacctgtagctcttggaatgtggtgaggacattgcaagcacctccagaaggtctctctccacctgtgatatcctatgtttctatgaatccccaaaaactgctgatttcctggatcccaccagaacagtctaatggtattatccagtcctataggcttcaaaggaatgaaatgctctatccttttagctttgatcctgtgactttcaattacactgatgaagagcttcttcctttttccacctatagctatgcactccaagcctgcacgagtggaggatgctccaccagcaaacccaccagcatcacaactctggaggctgctccatcagaagtcagccctccagatctttgggccgtcagtgccactcaaatgaatgtatgttggtcaccgcccacagtgcaaaatggaaagattactaaatatttagttagatatgataataaagagtcccttgctggccagggcctgtgcctgctggtttcccacctgcagccttactctcagtataacttctcccttgtagcctgcacgaatggaggttgcacagctagtgtgtcaaaatctgcctggacaatggaggccctgccagagaacatggactctccaacattgcaagtcacaggctcagaatcaatagaaatcacctggaaacctccaagaaacccaaatggccagatcagaagttatgaacttaggagggatggaaccattgtatatacaggcttggaaacacgctatcgtgattttactctcaccccaggtgtggagtatagctacacagtaactgccagcaacagccaagggggtattttgagtcctcttgtcaaagatcgaaccagcccctcagcaccctcagggatggaacctccaaaattgcaggccaggggtcctcaggagatcttagtgaactgggaccctccagtgagaacaaatggtgatatcatcaattataccctcttcatccgtgaactatttgaaagagaaactaaaatcatacacataaacacaactcataattcttttggtatgcagtcatatatagtaaaccagctgaagccatttcacaggtatgaaatacgaattcaagcgtgcaccaccctgggatgtgcatcaagtgactggacattcatacagacccctgagattgcacctttgatgcaaccccctccacatctggaggtacaaatggctccaggaggattccagccaactgtttctcttttgtggacaggaccgctgcagccaaatggaaaagttttgtattacgaattatacagaagacaaatagcaactcagcctagaaaatccaatccagtcctaatctataacggaagctcaacatcttttatagattccgaactattgcctttcacagagtatgagtatcaggtctgggcagtgaattctgcaggaaaagcccccagtagctggacatggtgcagaaccgggccagccccaccagaaggtctcagagcccccacgttccatgtgatctcttctacccaagcagtggtcaacatcagtgcccctgggaagcccaacgggatcgtcagtctctacaggctgttctccagcagcgcccatggggctgagacagtgctatccgaaggcatggccacccagcagactctccatggccttcaagccttcactaactactctattggagtagaggcctgcacctgcttcaactgttgcagcaaaggaccgacagctgaactgagaacccatcctgccccaccctcaggactgtcctctccacaaatcgggacgctggcctcaaggacggcctccttccggtggagtccccccatgttccccaatggtgtcattcacagctatgaactccaattccacgtggcttgccctcctgactcagccctcccctgtactcccagccaaatagaaacaaagtacacggggctggggcagaaagccagccttgggggtctccagccctacaccacatacaagctgagagtggtggcacacaacgaggtgggcagtacggcttccgagtggatcagtttcaccacccaaaaagaattgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaaccttctttttccaggtcatctgcacgactgacgaaggaagtgttaagacgccgttgatccaatatgatacctctactggacttggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatggggttagccgataccaaaattccccggtctgggacacctgtgagtatccgcagcaaccggagtgcatgtgtcctgcgcatcccgagtcaaaaccaaaccagcctaacctactcccagggttctcttcaccgcagcgtcagccagctcatggacattcaagacaagaaagtcttgatggacaactcactgtgggaagccatcatgggccacaacagtggactgtatgtggatgaagaggacctgatgaacgccatcaaggatttcagctcagtgactaaggaacgcaccacattcacagacacccacctgtaa

SEQ ID NO: 50 - protein, 5202 aa, Homo sapiens
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLRWFPPEELNGPSPIYQLERRESSLPALMTTMMKGIRFIGNGYCKFPSSTHPVNTDFTGIKASFRTKVPEGLIVFAASPGNQEEYFALQLKKGRLYFLFDPQGSPVEVTTTNDHGKQYSDGKWHEIIAIRHQAFGQITLDGIYTGSSAILNGSTVIGDNTGVFLGGLPRSYTILRKDPEIIQKGFVGCLKDVHFMKNYNPSAIWEPLDWQSSEEQINVYNSWEGCPASLNEGAQFLGAGFLELHPYMFHGGMNFEISFKFRTDQLNGLLLFVYNKDGPDFLAMELKSGILTFRLNTSLAFTQVDLLLGLSYCNGKWNKVIIKKEGSFISASVNGLMKHASESGDQPLVVNSPVYVGGIPQELLNSYQHLCLEQGFGGCMKDVKFTRGAVVNLASVSSGAVRVNLDGCLSTDSAVNCRGNDSILVYQGKEQSVYEGGLQPFTEYLYRVIASHEGGSVYSDWSRGRTTGAAPQSVPTPSRVRSLNGYSIEVTWDEPVVRGVIEKYILKAYSEDSTRPPRMPSASAEFVNTSNLTGILTGLLPFKNYAVTLTACTLAGCTESSHALNISTPQEAPQEVQPPVAKSLPSSLLLSWNPPKKANGIITQYCLYMDGRLIYSGSEENYIVTDLAVFTPHQFLLSACTHVGCTNSSWVLLYTAQLPPEHVDSPVLTVLDSRTIHIQWKQPRKISGILERYVLYMSNHTHDFTIWSVIYNSTELFQDHMLQYVLPGNKYLIKLGACTGGGCTVSEASEALTDEDIPEGVPAPKAHSYSPDSFNVSWTEPEYPNGVITSYGLYLDGILIHNSSELSYRAYGFAPWSLHSFRVQACTAKGCALGPLVENRTLEAPPEGTVNVFVKTQGSRKAHVRWEAPFRPNGLLTHSVLFTGIFYVDPVGNNYTLLNVTKVMYSGEETNLWVLIDGLVPFTNYTVQVNISNSQGSLITDPITIAMPPGAPDGVLPPRLSSATPTSLQVVWSTPARNNAPGSPRYQLQMRSGDSTHGFLELFSNPSASLSYEVSDLQPYTEYMFRLVASNGFGSAHSSWIPFMTAEDKPGPVVPPILLDVKSRMMLVTWQHPRKSNGVITHYNIYLHGRLYLRTPGNVTNCTVMHLHPYTAYKFQVEACTSKGCSLSPESQTVWTLPGAPEGIPSPELFSDTPTSVIISWQPPTHPNGLVENFTIERRVKGKEEVTTLVTLPRSHSMRFIDKTSALSPWTKYEYRVLMSTLHGGTNSSAWVEVTTRPSRPAGVQPPVVTVLEPDAVQVTWKPPLIQNGDILSYEIHMPDPHITLTNVTSAVLSQKVTHLIPFTNYSVTIVACSGGNGYLGGCTESLPTYVTTHPTVPQNVGPLSVIPLSESYVVISWQPPSKPNGPNLRYELLRRKIQQPLASNPPEDLNRWHNIYSGTQWLYEDKGLSRFTTYEYMLFVHNSVGFTPSREVTVTTLAGLPERGANLTASVLNHTAIDVRWAKPTVQDLQGEVEYYTLFWSSATSNDSLKILPDVNSHVIGHLKPNTEYWIFISVFNGVHSINSAGLHATTCDGEPQGMLPPEVVIINSTAVRVIWTSPSNPNGVVTEYSIYVNNKLYKTGMNVPGSFILRDLSPFTIYDIQVEVCTIYACVKSNGTQITTVEDTPSDIPTPTIRGITSRSLQIDWVSPRKPNGIILGYDLLWKTWYPCAKTQKLVQDQSDELCKAVRCQKPESICGHICYSSEAKVCCNGVLYNPKPGHRCCEEKYIPFVLNSTGVCCGGRIQEAQPNHQCCSGYYARILPGEVCCPDEQHNRVSVGIGDSCCGRMPYSTSGNQICCAGRLHDGHGQKCCGRQIVSNDLECCGGEEGVVYNRLPGMFCCGQDYVNMSDTICCSASSGESKAHIKKNDPVPVKCCETELIPKSQKCCNGVGYNPLKYVCSDKISTGMMMKETKECRILCPASMEATEHCGRCDFNFTSHICTVIRGSHNSTGKASIEEMCSSAEETIHTGSVNTYSYTDVNLKPYMTYEYRISAWNSYGRGLSKAVRARTKEDVPQGVSPPTWTKIDNLEDTIVLNWRKPIQSNGPIIYYILLRNGIERFRGTSLSFSDKEGIQPFQEYSYQLKACTVAGCATSSKVVAATTQGVPESILPPSITALSAVALHLSWSVPEKSNGVIKEYQIRQVGKGLIHTDTTDRRQHTVTGLQPYTNYSFTLTACTSAGCTSSEPFLGQTLQAAPEGVWVTPRHIIINSTTVELYWSLPEKPNGLVSQYQLSRNGNLLFLGGSEEQNFTDKNLEPNSRYTYKLEVKTGGGSSASDDYIVQTPMSTPEEIYPPYNITVIGPYSIFVAWIPPGILIPEIPVEYNVLLNDGSVTPLAFSVGHHQSTLLENLTPFTQYEIRIQACQNGSCGVSSRMFVKTPEAAPMDLNSPVLKALGSACIEIKWMPPEKPNGIIINYFIYRRPAGIEEESVLFVWSEGALEFMDEGDTLRPFTLYEYRVRACNSKGSVESLWSLTQTLEAPPQDFPAPWAQATSAHSVLLNWTKPESPNGIISHYRVVYQERPDDPTFNSPTVHAFTVKGTSHQAHLYGLEPFTTYRIGVVAANHAGEILSPWTLIQTLESSPSGLRNFIVEQKENGRALLLQWSEPMRTNGVIKTYNIFSDGFLEYSGLNRQFLFRRLDPFTLYTLTLEACTRAGCAHSAPQPLWTDEAPPDSQLAPTVHSVKSTSVELSWSEPVNPNGKIIRYEVIRRCFEGKAWGNQTIQADEKIVFTEYNTERNTFMYNDTGLQPWTQCEYKIYTWNSAGHTCSSWNVVRTLQAPPEGLSPPVISYVSMNPQKLLISWIPPEQSNGIIQSYRLQRNEMLYPFSFDPVTFNYTDEELLPFSTYSYALQACTSGGCSTSKPTSITTLEAAPSEVSPPDLWAVSATQMNVCWSPPTVQNGKITKYLVRYDNKESLAGQGLCLLVSHLQPYSQYNFSLVACTNGGCTASVSKSAWTMEALPENMDSPTLQVTGSESIEITWKPPRNPNGQIRSYELRRDGTIVYTGLETRYRDFTLTPGVEYSYTVTASNSQGGILSPLVKDRTSPSAPSGMEPPKLQARGPQEILVNWDPPVRTNGDIINYTLFIRELFERETKIIHINTTHNSFGMQSYIVNQLKPFHRYEIRIQACTTLGCASSDWTFIQTPEIAPLMQPPPHLEVQMAPGGFQPTVSLLWTGPLQPNGKVLYYELYRRQIATQPRKSNPVLIYNGSSTSFIDSELLPFTEYEYQVWAVNSAGKAPSSWTWCRTGPAPPEGLRAPTFHVISSTQAVVNISAPGKPNGIVSLYRLFSSSAHGAETVLSEGMATQQTLHGLQAFTNYSIGVEACTCFNCCSKGPTAELRTHPAPPSGLSSPQIGTLASRTASFRWSPPMFPNGVIHSYELQFHVACPPDSALPCTPSQIETKYTGLGQKASLGGLQPYTTYKLRVVAHNEVGSTASEWISFTTQKELPQYRAPFSVDSNLSVVCVNWSDTFLLNGQLKEYVLTDGGRRVYSGLDTTLYIPRTADKTFFFQVICTTDEGSVKTPLIQYDTSTGLGLVLTTPGKKKGSRSKSTEFYSELWFIVLMAMLGLILLAIFLSLILQRKIHKEPYIRERPPLVPLQKRMSPLNVYPPGENHMGLADTKIPRSGTPVSIRSNRSACVLRIPSQNQTSLTYSQGSLHRSVSQLMDIQDKKVLMDNSLWEAIMGHNSGLYVDEEDLMNAIKDFSSVTKERTTFTDTHL

SEQ ID NO: 51 - DNA, 4386 bp, Artificial Sequence
  SV40 NLS_dCas9_SV40 NLS_VP64
atgagccccaagaagaagagaaaggtggaggccagcgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgctggatccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctg

SEQ ID NO: 52 - DNA, 1419 bp, Artificial Sequence
  MS2-N55K_SV40 NLS_P65_HSF1
atggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctacagcgctggaggaggtggaagcggaggaggaggaagcggaggaggaggtagcggacctaagaaaaagaggaaggtggcggccgctggatccccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggaggaggtggaagcggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcc

SEQ ID NO: 53 - DNA, 410 bp, Artificial Sequence
  U6-sgRNA MS2 stem loop
gagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgggtcttcgagaagacctgttttagagctaggccaacatgaggatcacccatgtctgcagggcctagcaagttaaaataaggctagtccgttatcaacttggccaacatgaggatcacccatgtctgcagggccaagtggcaccgagtcggtgcttttttt

SEQ ID NO: 54 - DNA, 5145 bp, Artificial Sequence
  SV40NLS-dCas9-HA-2xSV40NLS-10xGCN4_v4-SV40 NLS
cccaagaagaagcgcaaggtgggacgcgtctgcaggatatcaagcttgcggtaccgcgggcccgggatcgccaccatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccaacggtccgactgacgccgcggaagaagaacttttgagcaagaattatcatcttgagaacgaagtggctcgtcttaagaaaggttctggcagtggagaagaactgctttcaaagaattaccacctggaaaatgaggtagctagactgaaaaaggggagcggaagtggggaggagttgctgagcaaaaattatcatttggagaacgaagtagcacgactaaagaaagggtccggatcgggtgaggagttactctcgaaaaattatcatctcgaaaacgaagtggctcggctaaaaaagggcagtggttctggagaagagctattatctaaaaactaccacctcgaaaatgaggtggcacgcttaaaaaagggaagtggcagtggtgaagagctactatccaagaattatcatcttgagaacgaggtagcgcgtttgaagaagggttccggctcaggagaggaactgctctcgaagaactatcatcttgaaaatgaggtcgctcgattaaaaaagggatcgggcagtggtgaggaactactttcaaagaattaccacctcgaaaacgaagtagctcgattaaagaaaggttcagggtcgggtgaagaattactgagtaaaaattatcatctggaaaatgaggtagcgagactaaaaaaggggagtggttctggcgaggaattgctatcgaaaaattatcatcttgagaacgaagttgctaggctcaaaaagggctcaggctcaggcaccgcggtaaacataggtggtggaaccggtccgatggatctacagcggccgcaaggtggaggtggacccaagaagaagcgcaaggtg

SEQ ID NO: 55 - DNA, 2034 bp, Artificial Sequence
  scFv-GCN4-sfGFP-VP64-GB1-RexNLS
atgggccccgacatcgtgatgacccagagccccagcagcctgagcgccagcgtgggcgaccgcgtgaccatcacctgccgcagcagcaccggcgccgtgaccaccagcaactacgccagctgggtgcaggagaagcccggcaagctgttcaagggcctgatcggcggcaccaacaaccgcgcccccggcgtgcccagccgcttcagcggcagcctgatcggcgacaaggccaccctgaccatcagcagcctgcagcccgaggacttcgccacctacttctgcgccctgtggtacagcaaccactgggtgttcggccagggcaccaaggtggagctgaagcgcggcggcggcggcagcggcggcggcggcagcggcggcggcggcagcagcggcggcggcagcgaggtgaagctgctggagagcggcggcggcctggtgcagcccggcggcagcctgaagctgagctgcgccgtgagcggcttcagcctgaccgactacggcgtgaactgggtgcgccaggcccccggccgcggcctggagtggatcggcgtgatctggggcgacggcatcaccgactacaacagcgccctgaaggaccgcttcatcatcagcaaggacaacggcaagaacaccgtgtacctgcagatgagcaaggtgcgcagcgacgacaccgccctgtactactgcgtgaccggcctgttcgactactggggccagggcaccctggtgaccgtgagcagctacccatacgatgttccagattacgctggtggaggcggaggttctgggggaggaggtagtggcggtggtggttcaggaggcggcggaagcttggatccaggtggaggtggaagcggtagcaaaggagaagaacttttcactggagttgtcccaattcttgttgaattagatggtgatgttaatgggcacaaattttctgtccgtggagagggtgaaggtgatgctacaaacggaaaactcacccttaaatttatttgcactactggaaaactacctgttccgtggccaacacttgtcactactctgacctatggtgttcaatgcttttcccgttatccggatcacatgaaacggcatgactttttcaagagtgccatgcccgaaggttatgtacaggaacgcactatatctttcaaagatgacgggacctacaagacgcgtgctgaagtcaagtttgaaggtgatacccttgttaatcgtatcgagttaaagggtattgattttaaagaagatggaaacattcttggacacaaactcgagtacaactttaactcacacaatgtatacatcacggcagacaaacaaaagaatggaatcaaagctaacttcaaaattcgccacaacgttgaagatggttccgttcaactagcagaccattatcaacaaaatactccaattggcgatggccctgtccttttaccagacaaccattacctgtcgacacaatctgtcctttcgaaagatcccaacgaaaagcgtgaccacatggtccttcttgagtttgtaactgctgctgggattacacatggcatggatgagctctacaaaggtggaggtcggaccggtggcggtggcggaggggatgctttagacgattttgacttagatatgcttggttcagacgcgttagacgacttcgacctagacatgttaggctcagatgcattggacgacttcgatttagatatgttgggctccgatgccctagatgactttgatctagatatgctaggtagtggaggaggatctcggaccgaagagtacaagcttatcctgaacggtaaaaccctgaaaggtgaaaccaccaccgaagctgttgacgctgctaccgcggaaaaagttttcaaacagtacgctaacgacaacggtgttgacggtgaatggacctacgacgacgctaccaaaaccttcacggtaaccgaaggtggtggtagcggtggtggtactagtccaaaaacaaggaggagaccgcgaagatcacaacggaaaaggccgcctacgccatggccgtaa

SEQ ID NO: 56 - DNA, 5796 bp, Artificial Sequence
  dCas9m4-SV40NLS-VP64- SV40NLS-p65-Rta (VPR)
atggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggctgctatcgtgccccagtcttttctcaaagatgattctattgataataaagtgttgacaagatccgataaagctagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttt

SEQ ID NO: 57 - DNA, 5796 bp, Artificial Sequence
  Cas9-SV40NLS-VP64-SV40NLS-p65-Rta
atggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttt

SEQ ID NO: 58 - DNA, 2493 bp, Artificial Sequence
  SV40NLS- dCas9m2-RmaIntN_coding sequence (D10A)
atggccccaaagaagaagcggaaggtcggtatccacggagtcccagcagccgacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggaaacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttgtctggctggcgatactctcattaccctggccgatggacgacgagtgcctattagagaactggtgtcacagcagaatttttccgtgtgggctctgaatcctcagacttaccgcctggagagggctagagtgagtagagctttctgtaccggcatcaaacctgtgtaccgcctcaccactagactggggagatccattagggccactgccaaccaccgatttctcacacctcagggctggaaacgagtcgatgaactccagcctggagattacctggctctgcctaggagaatccctactgcctcc

SEQ ID NO: 59 - DNA, 3813 bp, Artificial Sequence
  RmaIntC-dCas9m2-VP64-p65-Rta (D839A: GAT>GCT, H840A, N863A: AAT>GCT)
atggcggcggcgtgcccggaactgcgtcagctggcgcagagcgatgtgtattgggatccgattgtgagcattgaaccggatggcgtggaagaagtgtttgatctgaccgtgccgggcccgcataactttgtggcgaacgatattattgcgcataactctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatgctatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttt

SEQ ID NO: 60 - DNA, 4532 bp, Artificial Sequence
  ITR-hRHO-RmaIntC-dCas9C(m2)-NLS-VP64-NLS-p65-Rta-pA-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaatagctagccctctcctccctgacctcaggcttcctcctagtgtcaccttggcccctcttagaagccaattaggccctcagtttctgcagcggggattaatatgattatgaacacccccaatctcccagatgctgattcagccaggagcttaggagggggaggtcactttataagggtctgggggggtcagaacccagagtcatcggtaccaccggtcgactagaggatccatggcggcggcgtgcccggaactgcgtcagctggcgcagagcgatgtgtattgggatccgattgtgagcattgaaccggatggcgtggaagaagtgtttgatctgaccgtgccgggcccgcataactttgtggcgaacgatattattgcgcataactctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatgctatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttttgacaataaaatatctttattttcattacatctgtgtgttggttttttgtgtctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 61 - DNA, 4848 bp, Artificial Sequence
  ITR-mSWS-RmaIntC-dCas9C(m2)-NLS-VP64-NLS-p65-Rta-pA-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaatagctagcaggatgcagttgtttctgcactgtcccgcagtggctatttaaaatgctcccaagggggcctccccactcatcctcttcctgtttccccaagcggattcccaggtctctggatagggacactcaggtgagcatctttcacaaagggccaggtgagatgcagaggagcctgaagccaaaggcagaggtgggaatgaggtatggcagcatctccaaagaatataggtcagcatcctccaggccacagaaaccaatactgaccccaaagcacccagccttgttatccaggtttctgacctcaatctcttatcctctgaagaacacaatcaatcagctttgggctcatgaaaggtttaggtgagaactaagagatctctaatctgggactttgtctttgggaggcttaggatagttcagagtctcaactgtatctttaaaggagggtgctgtagggaagggtgatagcagaagaatcgtctataagagggaccggaggtggtagtgagggcatcccaagcgggaccggtcgactagaggatccatggcggcggcgtgcccggaactgcgtcagctggcgcagagcgatgtgtattgggatccgattgtgagcattgaaccggatggcgtggaagaagtgtttgatctgaccgtgccgggcccgcataactttgtggcgaacgatattattgcgcataactctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatgctatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttttgacaataaaatatctttattttcattacatctgtgtgttggttttttgtgtctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 62 - DNA, 4679 bp, Artificial Sequence
  ITR-hU6-Cnga1.sgRNA#1-sgRNAscaffold-hU6-Cnga1.sgRNA#2-sgRNAscaffo ld-hU6-Cnga1.sgRNA#3-sgRNAscaffold-mSWS-NLS-dCas9N(m2)-RmaIntN-pA -ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaggcgaccggctttgagaagttttagagctagaaatagcaagttaaaataaggctagtccgttatcaacttgaaaaagtggcaccgagtcggtgctttttttgtatacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgctgtggaagtctccaaacgcgttttagagctagaaatagcaagttaaaataaggctagtccgttatcaacttgaaaaagtggcaccgagtcggtgctttttttgttaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtcttctctctcggcgctatggttttagagctagaaatagcaagttaaaataaggctagtccgttatcaacttgaaaaagtggcaccgagtcggtgctttttttatttaaatagctagcaggatgcagttgtttctgcactgtcccgcagtggctatttaaaatgctcccaagggggcctccccactcatcctcttcctgtttccccaagcggattcccaggtctctggatagggacactcaggtgagcatctttcacaaagggccaggtgagatgcagaggagcctgaagccaaaggcagaggtgggaatgaggtatggcagcatctccaaagaatataggtcagcatcctccaggccacagaaaccaatactgaccccaaagcacccagccttgttatccaggtttctgacctcaatctcttatcctctgaagaacacaatcaatcagctttgggctcatgaaaggtttaggtgagaactaagagatctctaatctgggactttgtctttgggaggcttaggatagttcagagtctcaactgtatctttaaaggagggtgctgtagggaagggtgatagcagaagaatcgtctataagagggaccggaggtggtagtgagggcatcccaagcgggaccggtcgactagaggatccatggccccaaagaagaagcggaaggtcggtatccacggagtcccagcagccgacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggaaacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttgtctggctggcgatactctcattaccctggccgatggacgacgagtgcctattagagaactggtgtcacagcagaatttttccgtgtgggctctgaatcctcagacttaccgcctggagagggctagagtgagtagagctttctgtaccggcatcaaacctgtgtaccgcctcaccactagactggggagatccattagggccactgccaaccaccgatttctcacacctcagggctggaaacgagtcgatgaactccagcctggagattacctggctctgcctaggagaatccctactgcctcctgatctcgagctcgatgagtttggacaaaccacaactagaatgcagtgaaaaaaatgctttatttgtgaaatttgtgatgctattgctttatttgtaaccattataagctgcaataaacaagttctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 63 - DNA, 4356 bp, Artificial Sequence
  ITR-hU6-Opn1mw.sgRNA#1-sgRNAscaffold-hU6-Opn1mw.sgRNA#2-sgRNAscaf fold-hU6-Opn1mw.sgRNA#3-sgRNAscaffold-hRHO-NLS-dCas9N(m2)-RmaIntN -pA-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtttgggggcctttaaggtagttttagagctagaaatagcaagttaaaataaggctagtccgttatcaacttgaaaaagtggcaccgagtcggtgctttttttgtatacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgcctgagccacccctgtggatgttttagagctagaaatagcaagttaaaataaggctagtccgttatcaacttgaaaaagtggcaccgagtcggtgctttttttgttaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtagctcttgcttgtttacaagttttagagctagaaatagcaagttaaaataaggctagtccgttatcaacttgaaaaagtggcaccgagtcggtgctttttttatttaaatagctagccctctcctccctgacctcaggcttcctcctagtgtcaccttggcccctcttagaagccaattaggccctcagtttctgcagcggggattaatatgattatgaacacccccaatctcccagatgctgattcagccaggagcttaggagggggaggtcactttataagggtctgggggggtcagaacccagagtcatcaccggtcgactagaggatccatggccccaaagaagaagcggaaggtcggtatccacggagtcccagcagccgacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggaaacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttgtctggctggcgatactctcattaccctggccgatggacgacgagtgcctattagagaactggtgtcacagcagaatttttccgtgtgggctctgaatcctcagacttaccgcctggagagggctagagtgagtagagctttctgtaccggcatcaaacctgtgtaccgcctcaccactagactggggagatccattagggccactgccaaccaccgatttctcacacctcagggctggaaacgagtcgatgaactccagcctggagattacctggctctgcctaggagaatccctactgcctcctgatctcgagctcgatgagtttggacaaaccacaactagaatgcagtgaaaaaaatgctttatttgtgaaatttgtgatgctattgctttatttgtaaccattataagctgcaataaacaagttctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 64 - DNA, 4356 bp, Artificial Sequence
  pAAV-3xsgRNA.Opn1sw-hRHO_dCas9N-IntN-SV40polyA ITR-hU6-Opn1sw.sgRNA#1-sgRNAscaffold-hU6-Opn1sw.sgRNA#2-sgRNAscaf fold-hU6-Opn1sw.sgRNA#3-sgRNAscaffold-hRHO-NLS-dCas9N(m2)-RmaIntN -SV40pA-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaacacaatcaatcagctttgttttagagctagaaatagcaagttaaaataaggctagtccgttatcaacttgaaaaagtggcaccgagtcggtgctttttttgtatacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgagcacccagccttgttatccgttttagagctagaaatagcaagttaaaataaggctagtccgttatcaacttgaaaaagtggcaccgagtcggtgctttttttgttaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgagcatctttcacaaagggccgttttagagctagaaatagcaagttaaaataaggctagtccgttatcaacttgaaaaagtggcaccgagtcggtgctttttttatttaaatagctagccctctcctccctgacctcaggcttcctcctagtgtcaccttggcccctcttagaagccaattaggccctcagtttctgcagcggggattaatatgattatgaacacccccaatctcccagatgctgattcagccaggagcttaggagggggaggtcactttataagggtctgggggggtcagaacccagagtcatcaccggtcgactagaggatccatggccccaaagaagaagcggaaggtcggtatccacggagtcccagcagccgacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggaaacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttgtctggctggcgatactctcattaccctggccgatggacgacgagtgcctattagagaactggtgtcacagcagaatttttccgtgtgggctctgaatcctcagacttaccgcctggagagggctagagtgagtagagctttctgtaccggcatcaaacctgtgtaccgcctcaccactagactggggagatccattagggccactgccaaccaccgatttctcacacctcagggctggaaacgagtcgatgaactccagcctggagattacctggctctgcctaggagaatccctactgcctcctgatctcgagctcgatgagtttggacaaaccacaactagaatgcagtgaaaaaaatgctttatttgtgaaatttgtgatgctattgctttatttgtaaccattataagctgcaataaacaagttctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 65 - DNA, 4758 bp, Artificial Sequence
  ITR-hU6-Rho.sgRNA-sgRNAscaffold-hU6-Opn1mw.sgRNA#1truncated-sgRNA scaffold-hU6-Opn1mw.sgRNA#2truncated-sgRNAscaffold-CMV-NLS-Cas9N- RmaIntN-SV40pA-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtacggtgacgtagagcgtggttttagagctagaaatagcaagttaaaataaggctagtccgttatcaacttgaaaaagtggcaccgagtcggtgctttttttgtatacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggggcctttaaggtagttttagagctagaaatagcaagttaaaataaggctagtccgttatcaacttgaaaaagtggcaccgagtcggtgctttttttgttaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgccacccctgtggatgttttagagctagaaatagcaagttaaaataaggctagtccgttatcaacttgaaaaagtggcaccgagtcggtgctttttttatttaaatagctagcacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagaaccggtcgactagaggatccatggccccaaagaagaagcggaaggtcggtatccacggagtcccagcagccgacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggaaacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttgtctggctggcgatactctcattaccctggccgatggacgacgagtgcctattagagaactggtgtcacagcagaatttttccgtgtgggctctgaatcctcagacttaccgcctggagagggctagagtgagtagagctttctgtaccggcatcaaacctgtgtaccgcctcaccactagactggggagatccattagggccactgccaaccaccgatttctcacacctcagggctggaaacgagtcgatgaactccagcctggagattacctggctctgcctaggagaatccctactgcctcctgatctcgagctcgatgagtttggacaaaccacaactagaatgcagtgaaaaaaatgctttatttgtgaaatttgtgatgctattgctttatttgtaaccattataagctgcaataaacaagttctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 66 - DNA, 4350 bp, Artificial Sequence
  ITR-hU6-Rho.sgRNA-sgRNAscaffold-hU6-Opn1mw.sgRNA#1truncated-sgRNA scaffold-hU6-Opn1mw.sgRNA#2truncated-sgRNAscaffold-hRHO-NLS-Cas9N -RmaIntN-pA-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtacggtgacgtagagcgtggttttagagctagaaatagcaagttaaaataaggctagtccgttatcaacttgaaaaagtggcaccgagtcggtgctttttttgtatacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggggcctttaaggtagttttagagctagaaatagcaagttaaaataaggctagtccgttatcaacttgaaaaagtggcaccgagtcggtgctttttttgttaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgccacccctgtggatgttttagagctagaaatagcaagttaaaataaggctagtccgttatcaacttgaaaaagtggcaccgagtcggtgctttttttatttaaatagctagccctctcctccctgacctcaggcttcctcctagtgtcaccttggcccctcttagaagccaattaggccctcagtttctgcagcggggattaatatgattatgaacacccccaatctcccagatgctgattcagccaggagcttaggagggggaggtcactttataagggtctgggggggtcagaacccagagtcatcggtaccaccggtcgactagaggatccatggccccaaagaagaagcggaaggtcggtatccacggagtcccagcagccgacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggaaacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttgtctggctggcgatactctcattaccctggccgatggacgacgagtgcctattagagaactggtgtcacagcagaatttttccgtgtgggctctgaatcctcagacttaccgcctggagagggctagagtgagtagagctttctgtaccggcatcaaacctgtgtaccgcctcaccactagactggggagatccattagggccactgccaaccaccgatttctcacacctcagggctggaaacgagtcgatgaactccagcctggagattacctggctctgcctaggagaatccctactgcctcctgatctcgagctcgatgagtttggacaaaccacaactagaatgcagtgaaaaaaatgctttatttgtgaaatttgtgatgctattgctttatttgtaaccattataagctgcaataaacaagttctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 67 - DNA, 4946 bp, Artificial Sequence
  ITR-CMV-RmaIntC-Cas9C-NLS-VP64-NLS-p65-Rta-pA-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaatagctagcacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagaggtaccaccggtcgactagaggatccatggcggcggcgtgcccggaactgcgtcagctggcgcagagcgatgtgtattgggatccgattgtgagcattgaaccggatggcgtggaagaagtgtttgatctgaccgtgccgggcccgcataactttgtggcgaacgatattattgcgcataactctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttttgacaataaaatatctttattttcattacatctgtgtgttggttttttgtgtctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 68 - DNA, 4532 bp, Artificial Sequence
  ITR-hRHO-RmaIntC-Cas9C-NLS-VP64-NLS-p65-Rta-pA-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaatagctagccctctcctccctgacctcaggcttcctcctagtgtcaccttggcccctcttagaagccaattaggccctcagtttctgcagcggggattaatatgattatgaacacccccaatctcccagatgctgattcagccaggagcttaggagggggaggtcactttataagggtctgggggggtcagaacccagagtcatcggtaccaccggtcgactagaggatccatggcggcggcgtgcccggaactgcgtcagctggcgcagagcgatgtgtattgggatccgattgtgagcattgaaccggatggcgtggaagaagtgtttgatctgaccgtgccgggcccgcataactttgtggcgaacgatattattgcgcataactctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttttgacaataaaatatctttattttcattacatctgtgtgttggttttttgtgtctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 69 - DNA, 4660 bp, Artificial Sequence
  ITR-hU6-Rho.sgRNA-sgRNAscaffold-hU6-Opn1mw.sgRNA#1truncated-sgRNA scaffold-hU6-Opn1mw.sgRNA#2truncated-sgRNAscaffold-CMV-NLS-Cas9N- DSS-BDlacZ-pA-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtacggtgacgtagagcgtggttttagagctagaaatagcaagttaaaataaggctagtccgttatcaacttgaaaaagtggcaccgagtcggtgctttttttgtatacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggggcctttaaggtagttttagagctagaaatagcaagttaaaataaggctagtccgttatcaacttgaaaaagtggcaccgagtcggtgctttttttgttaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgccacccctgtggatgttttagagctagaaatagcaagttaaaataaggctagtccgttatcaacttgaaaaagtggcaccgagtcggtgctttttttatttaaatagctagcacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagaaccggtcgactagaggatccatggccccaaagaagaagcggaaggtcggtatccacggagtcccagcagccgacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggaaacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtaagggcactgagcagaagggaagaagctccgggggctctttgtagggtgcggccgcagtgcatcaaggcgatcacatcagtgaaaaaaagccagacaggcggttaaaccaacgcagattaaacagcaggatgcaaaaattcgcaggtggtcagatggcggccgctctagactcgatgagtttggacaaaccacaactagaatgcagtgaaaaaaatgctttatttgtgaaatttgtgatgctattgctttatttgtaaccattataagctgcaataaacaagttctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 70 - DNA, 4252 bp, Artificial Sequence
  ITR-hU6-Rho.sgRNA-sgRNAscaffold-hU6-Opn1mw.sgRNA#1truncated-sgRNA scaffold-hU6-Opn1mw.sgRNA#2truncated-sgRNAscaffold-hRHO-NLS-Cas9N -DSS-BDlacZ-pA-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtacggtgacgtagagcgtggttttagagctagaaatagcaagttaaaataaggctagtccgttatcaacttgaaaaagtggcaccgagtcggtgctttttttgtatacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggggcctttaaggtagttttagagctagaaatagcaagttaaaataaggctagtccgttatcaacttgaaaaagtggcaccgagtcggtgctttttttgttaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgccacccctgtggatgttttagagctagaaatagcaagttaaaataaggctagtccgttatcaacttgaaaaagtggcaccgagtcggtgctttttttatttaaatagctagccctctcctccctgacctcaggcttcctcctagtgtcaccttggcccctcttagaagccaattaggccctcagtttctgcagcggggattaatatgattatgaacacccccaatctcccagatgctgattcagccaggagcttaggagggggaggtcactttataagggtctgggggggtcagaacccagagtcatcggtaccaccggtcgactagaggatccatggccccaaagaagaagcggaaggtcggtatccacggagtcccagcagccgacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggaaacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtaagggcactgagcagaagggaagaagctccgggggctctttgtagggtgcggccgcagtgcatcaaggcgatcacatcagtgaaaaaaagccagacaggcggttaaaccaacgcagattaaacagcaggatgcaaaaattcgcaggtggtcagatggcggccgctctagactcgatgagtttggacaaaccacaactagaatgcagtgaaaaaaatgctttatttgtgaaatttgtgatgctattgctttatttgtaaccattataagctgcaataaacaagttctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 71 - DNA, 4882 bp, Artificial Sequence
  ITR-CMV-BDlacZ-ASS-Cas9C-NLS-VP64-NLS-p65-Rta-pA-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaatagctagcacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagaggtaccaccggtcgactagaggatcccggccgccatctgaccacctgcgaatttttgcatcctgctgtttaatctgcgttggtttaaccgcctgtctggctttttttcactgatgtgatcgccttgatgcactcggccgccaacgagtcttttgtcatctacaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttttgacaataaaatatctttattttcattacatctgtgtgttggttttttgtgtctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 72 - DNA, 4468 bp, Artificial Sequence
  ITR-hRHO-BDlacZ-ASS-Cas9C-NLS-VP64-NLS-p65-Rta-pA-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagggcgcgccgtttaaatagctagccctctcctccctgacctcaggcttcctcctagtgtcaccttggcccctcttagaagccaattaggccctcagtttctgcagcggggattaatatgattatgaacacccccaatctcccagatgctgattcagccaggagcttaggagggggaggtcactttataagggtctgggggggtcagaacccagagtcatcggtaccaccggtcgactagaggatcccggccgccatctgaccacctgcgaatttttgcatcctgctgtttaatctgcgttggtttaaccgcctgtctggctttttttcactgatgtgatcgccttgatgcactcggccgccaacgagtcttttgtcatctacaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttttgacaataaaatatctttattttcattacatctgtgtgttggttttttgtgtctcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 73 - DNA, 150 bp, Artificial Sequence
  Vp64
gacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctg

SEQ ID NO: 74 - DNA, 375 bp, Artificial Sequence
  p65
cctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagc

SEQ ID NO: 75 - DNA, 570 bp, Artificial Sequence
  Rta
cgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttt

SEQ ID NO: 76 - DNA, 23 bp, Artificial Sequence
  sgCnga1_1
taggcgaccggctttgagaaagg

SEQ ID NO: 77 - DNA, 23 bp, Artificial Sequence
  sgCnga1_2
ctgtggaagtctccaaacgctgg

SEQ ID NO: 78 - DNA, 23 bp, Artificial Sequence
  sgCnga1_3
tcttctctctcggcgctatgcgg

SEQ ID NO: 79 - DNA, 23 bp, Artificial Sequence
  sgOpn1mw_1
gtttgggggcctttaaggtaagg

SEQ ID NO: 80 - DNA, 23 bp, Artificial Sequence
  sgOpn1mw_2
cctgagccacccctgtggattgg

SEQ ID NO: 81 - DNA, 23 bp, Artificial Sequence
  sgOpn1mw_3
tagctcttgcttgtttacaaggg

SEQ ID NO: 82 - DNA, 23 bp, Artificial Sequence
  sgRho
gtacggtgacgtagagcgtgagg

SEQ ID NO: 83 - DNA, 23 bp, Artificial Sequence
  sgOpn1sw_1
gaacacaatcaatcagctttggg

SEQ ID NO: 84 - DNA, 23 bp, Artificial Sequence
  sgOpn1sw_2
agcacccagccttgttatccagg

SEQ ID NO: 85 - DNA, 23 bp, Artificial Sequence
  sgOpn1sw_3
agcatctttcacaaagggccagg

SEQ ID NO: 86 - DNA, 23 bp, Artificial Sequence
  sgUSH2A_1
tctatcaatgggccaagctttgg

SEQ ID NO: 87 - DNA, 23 bp, Artificial Sequence
  sgUSH2A_2
agaggggggattataggataagg

SEQ ID NO: 88 - DNA, 23 bp, Artificial Sequence
  sgUSH2A_3
gaggtaccagcggaaagcttggg

SEQ ID NO: 89 - DNA, 1500 bp, Artificial Sequence
  VP64-p65-Rta (VPR)
gacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgcagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgcgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttt

SEQ ID NO: 90 - DNA, 6002 bp, Artificial Sequence
  SAM (synergistic activation mediator)
atggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatgctatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtggacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgatggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctacccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctccgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgggtcttcgagaagacctgttttagagctaggccaacatgaggatcacccatgtctgcagggcctagcaagttaaaataaggctagtccgttatcaacttggccaacatgaggatcacccatgtctgcagggccaagtggcaccgagtcggtgcttttttt

SEQ ID NO: 91 - DNA, 5823 bp, Artificial Sequence
  SunTag (dCas9(m2)-10xGCN4_v4-scFv-GCN4-VP64)
atggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatgctatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtggaagaacttttgagcaagaattatcatcttgagaacgaagtggctcgtcttaagaaaggttctggcagtggagaagaactgctttcaaagaattaccacctggaaaatgaggtagctagactgaaaaaggggagcggaagtggggaggagttgctgagcaaaaattatcatttggagaacgaagtagcacgactaaagaaagggtccggatcgggtgaggagttactctcgaaaaattatcatctcgaaaacgaagtggctcggctaaaaaagggcagtggttctggagaagagctattatctaaaaactaccacctcgaaaatgaggtggcacgcttaaaaaagggaagtggcagtggtgaagagctactatccaagaattatcatcttgagaacgaggtagcgcgtttgaagaagggttccggctcaggagaggaactgctctcgaagaactatcatcttgaaaatgaggtcgctcgattaaaaaagggatcgggcagtggtgaggaactactttcaaagaattaccacctcgaaaacgaagtagctcgattaaagaaaggttcagggtcgggtgaagaattactgagtaaaaattatcatctggaaaatgaggtagcgagactaaaaaaggggagtggttctggcgaggaattgctatcgaaaaattatcatcttgagaacgaagttgctaggctcaaaaagatgggccccgacatcgtgatgacccagagccccagcagcctgagcgccagcgtgggcgaccgcgtgaccatcacctgccgcagcagcaccggcgccgtgaccaccagcaactacgccagctgggtgcaggagaagcccggcaagctgttcaagggcctgatcggcggcaccaacaaccgcgcccccggcgtgcccagccgcttcagcggcagcctgatcggcgacaaggccaccctgaccatcagcagcctgcagcccgaggacttcgccacctacttctgcgccctgtggtacagcaaccactgggtgttcggccagggcaccaaggtggagctgaagcgcggcggcggcggcagcggcggcggcggcagcggcggcggcggcagcagcggcggcggcagcgaggtgaagctgctggagagcggcggcggcctggtgcagcccggcggcagcctgaagctgagctgcgccgtgagcggcttcagcctgaccgactacggcgtgaactgggtgcgccaggcccccggccgcggcctggagtggatcggcgtgatctggggcgacggcatcaccgactacaacagcgccctgaaggaccgcttcatcatcagcaaggacaacggcaagaacaccgtgtacctgcagatgagcaaggtgcgcagcgacgacaccgccctgtactactgcgtgaccggcctgttcgactactggggccagggcaccctggtgaccgtgagcagctacccatacgatgttccagattacgctggtggaggcggaggttctgggggaggaggtagtggcggtggtggttcaggaggcggcggaagcgatgctttagacgattttgacttagatatgcttggttcagacgcgttagacgacttcgacctagacatgttaggctcagatgcattggacgacttcgatttagatatgttgggctccgatgccctagatgactttgatctagatatgcta

SEQ ID NO: 92 - DNA, 4137 bp, Streptococcus pyogenes
atggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtg

SEQ ID NO: 93 - DNA, 3921 bp, Acidaminococcus sp. BV3L6
atgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctgctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaac

SEQ ID NO: 94 - DNA, 3387 bp, Alicyclobacillus acidiphilus
atggccgtgaagagcatgaaggtgaagctgcgcctggacaacatgcccgagatccgcgccggcctgtggaagctgcacaccgaggtgaacgccggcgtgcgctactacaccgagtggctgagcctgctgcgccaggagaacctgtaccgccgcagccccaacggcgacggcgagcaggagtgctacaagaccgccgaggagtgcaaggccgagctgctggagcgcctgcgcgcccgccaggtggagaacggccactgcggccccgccggcagcgacgacgagctgctgcagctggcccgccagctgtacgagctgctggtgccccaggccatcggcgccaagggcgacgcccagcagatcgcccgcaagttcctgagccccctggccgacaaggacgccgtgggcggcctgggcatcgccaaggccggcaacaagccccgctgggtgcgcatgcgcgaggccggcgagcccggctgggaggaggagaaggccaaggccgaggcccgcaagagcaccgaccgcaccgccgacgtgctgcgcgccctggccgacttcggcctgaagcccctgatgcgcgtgtacaccgacagcgacatgagcagcgtgcagtggaagcccctgcgcaagggccaggccgtgcgcacctgggaccgcgacatgttccagcaggccatcgagcgcatgatgagctgggagagctggaaccagcgcgtgggcgaggcctacgccaagctggtggagcagaagagccgcttcgagcagaagaacttcgtgggccaggagcacctggtgcagctggtgaaccagctgcagcaggacatgaaggaggccagccacggcctggagagcaaggagcagaccgcccactacctgaccggccgcgccctgcgcggcagcgacaaggtgttcgagaagtgggagaagctggaccccgacgcccccttcgacctgtacgacaccgagatcaagaacgtgcagcgccgcaacacccgccgcttcggcagccacgacctgttcgccaagctggccgagcccaagtaccaggccctgtggcgcgaggacgccagcttcctgacccgctacgccgtgtacaacagcatcgtgcgcaagctgaaccacgccaagatgttcgccaccttcaccctgcccgacgccaccgcccaccccatctggacccgcttcgacaagctgggcggcaacctgcaccagtacaccttcctgttcaacgagttcggcgagggccgccacgccatccgcttccagaagctgctgaccgtggaggacggcgtggccaaggaggtggacgacgtgaccgtgcccatcagcatgagcgcccagctggacgacctgctgccccgcgacccccacgagctggtggccctgtacttccaggactacggcgccgagcagcacctggccggcgagttcggcggcgccaagatccagtaccgccgcgaccagctgaaccacctgcacgcccgccgcggcgcccgcgacgtgtacctgaacctgagcgtgcgcgtgcagagccagagcgaggcccgcggcgagcgccgccccccctacgccgccgtgttccgcctggtgggcgacaaccaccgcgccttcgtgcacttcgacaagctgagcgactacctggccgagcaccccgacgacggcaagctgggcagcgagggcctgctgagcggcctgcgcgtgatgagcgtggacctgggcctgcgcaccagcgccagcatcagcgtgttccgcgtggcccgcaaggacgagctgaagcccaacagcgagggccgcgtgcccttctgcttccccatcgagggcaacgagaacctggtggccgtgcacgagcgcagccagctgctgaagctgcccggcgagaccgagagcaaggacctgcgcgccatccgcgaggagcgccagcgcaccctgcgccagctgcgcacccagctggcctacctgcgcctgctggtgcgctgcggcagcgaggacgtgggccgccgcgagcgcagctgggccaagctgatcgagcagcccatggacgccaaccagatgacccccgactggcgcgaggccttcgaggacgagctgcagaagctgaagagcctgtacggcatctgcggcgaccgcgagtggaccgaggccgtgtacgagagcgtgcgccgcgtgtggcgccacatgggcaagcaggtgcgcgactggcgcaaggacgtgcgcagcggcgagcgccccaagatccgcggctaccagaaggacgtggtgggcggcaacagcatcgagcagatcgagtacctggagcgccagtacaagttcctgaagagctggagcttcttcggcaaggtgagcggccaggtgatccgcgccgagaagggcagccgcttcgccatcaccctgcgcgagcacatcgaccacgccaaggaggaccgcctgaagaagctggccgaccgcatcatcatggaggccctgggctacgtgtacgccctggacgacgagcgcggcaagggcaagtgggtggccaagtaccccccctgccagctgatcctgctggaggagctgagcgagtaccagttcaacaacgaccgcccccccagcgagaacaaccagctgatgcagtggagccaccgcggcgtgttccaggagctgctgaaccaggcccaggtgcacgacctgctggtgggcaccatgtacgccgccttcagcagccgcttcgacgcccgcaccggcgcccccggcatccgctgccgccgcgtgcccgcccgctgcgcccgcgagcagaaccccgagcccttcccctggtggctgaacaagttcgtggccgagcacaagctggacggctgccccctgcgcgccgacgacctgatccccaccggcgagggcgagttcttcgtgagccccttcagcgccgaggagggcgacttccaccagatccacgccgacctgaacgccgcccagaacctgcagcgccgcctgtggagcgacttcgacatcagccagatccgcctgcgctgcgactggggcgaggtggacggcgagcccgtgctgatcccccgcaccaccggcaagcgcaccgccgacagctacggcaacaaggtgttctacaccaagaccggcgtgacctactacgagcgcgagcgcggcaagaagcgccgcaaggtgttcgcccaggaggagctgagcgaggaggaggccgagctgctggtggaggccgacgaggcccgcgagaagagcgtggtgctgatgcgcgaccccagcggcatcatcaaccgcggcgactggacccgccagaaggagttctggagcatggtgaaccagcgcatcgagggctacctggtgaagcagatccgcagccgcgtgcgcctgcaggagagcgcctgcgagaacaccggcgacatc

SEQ ID NO: 95 - DNA, 5637 bp, Artificial Sequence
  dCas9(m2)-VPR
atggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatgctatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtggacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgcagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgcgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttt

SEQ ID NO: 96 - DNA, 4137 bp, Artificial Sequence
  dCas9(m2) (D10A, H840A)
atggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatgctatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtg

SEQ ID NO: 97 - DNA, 4137 bp, Artificial Sequence
  dCas9(m4) (D10A, D839A, H840A, N863A)
atggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggctgctatcgtgccccagtcttttctcaaagatgattctattgataataaagtgttgacaagatccgataaagctagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtg

SEQ ID NO: 98 - DNA, 21 bp, Artificial Sequence
  USH2A_a_fwd primer
tgtttgctctgcagaatactt

SEQ ID NO: 99 - DNA, 20 bp, Artificial Sequence
  USH2A_a_rev
tttccgttggttgtggacta

SEQ ID NO: 100 - DNA, 21 bp, Artificial Sequence
  USH2A_b_for
gttggtacttcatgggtttca

SEQ ID NO: 101 - DNA, 20 bp, Artificial Sequence
  USH2A_b_rev
tggcattgcctggagaaata

SEQ ID NO: 102 - DNA, 21 bp, Artificial Sequence
  USH2A_c_for
gatgtgtgagtgtgattcctt

SEQ ID NO: 103 - DNA, 20 bp, Artificial Sequence
  USH2A_c_rev
ttcctttaaccagaggtggc

SEQ ID NO: 104 - DNA, 21 bp, Artificial Sequence
  USH2A_d_for
cccaagaactatcttacactg

SEQ ID NO: 105 - DNA, 21 bp, Artificial Sequence
  USH2A_d_rev
caggtcacctcaatgctgtat

SEQ ID NO: 106 - DNA, 19 bp, Artificial Sequence
  USH2A_e_for
agtcgaggacgtacaacag

SEQ ID NO: 107 - DNA, 21 bp, Artificial Sequence
  USH2A_e_rev
actatgtgcactgccaaatcc

SEQ ID NO: 108 - DNA, 17 bp, Artificial Sequence
  USH2A_f_for
gatgaggtctggcgact

SEQ ID NO: 109 - DNA, 21 bp, Artificial Sequence
  USH2A_f_rev
gagatgtccagatgacacgta

SEQ ID NO: 110 - DNA, 18 bp, Artificial Sequence
  USH2A_g_for
caggacttcatgcaacca

SEQ ID NO: 111 - DNA, 21 bp, Artificial Sequence
  USH2A_g_rev
cttgggtagtagctgcaacta

SEQ ID NO: 112 - DNA, 21 bp, Artificial Sequence
  USH2A_h_for
tatcagctgaaagcttgcacg

SEQ ID NO: 113 - DNA, 21 bp, Artificial Sequence
  USH2A_h_rev
ccgtcactgaagatgttgtat

SEQ ID NO: 114 - DNA, 21 bp, Artificial Sequence
  USH2A_i_for
gtagaacagaaagagaatggc

SEQ ID NO: 115 - DNA, 20 bp, Artificial Sequence
  USH2A_i_rev
catcaaaggtgcaatctcag

SEQ ID NO: 116 - DNA, 20 bp, Artificial Sequence
  USH2A_j_for
atagtaaaccagctgaagcc

SEQ ID NO: 117 - DNA, 20 bp, Artificial Sequence
  USH2A_j_rev
gttcatcaggtcctcttcat

SEQ ID NO: 118 - DNA, 21 bp, Artificial Sequence
  USH2A_k_for
ctcatggacattcaagacaag

SEQ ID NO: 119 - DNA, 21 bp, Artificial Sequence
  USH2A_k_rev
gactatcccttactttacaag

SEQ ID NO: 120 - DNA, 21 bp, Artificial Sequence
  USH2A_l_for
ctctgtctaacacacaatagt

SEQ ID NO: 121 - DNA, 23 bp, Artificial Sequence
  USH2A_l_rev
ggtcacattcaaatatttattaa

SEQ ID NO: 122 - DNA, 2448 bp, Homo sapiens
atggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcgtcatcaccaagtacttccgatggaggaactgactcacctggtactgcgtccccatctcctacaaagactactccatctcctcggcataaaaaaagtgattcttcaggtcaggagtacagcttgtga

SEQ ID NO: 123 - DNA, 11178 bp, Artificial Sequence
  PiggyBac-TRE-dCas9-VPR-polyA-3xsgRNA.Cnga1-EF1a-rtTA-T2A-PuroR-po lyA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttatgagggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaggcctccacggccactagttttactccctatcagtgatagagaacgtatgaagagtttactccctatcagtgatagagaacgtatgcagactttactccctatcagtgatagagaacgtataaggagtttactccctatcagtgatagagaacgtatgaccagtttactccctatcagtgatagagaacgtatctacagtttactccctatcagtgatagagaacgtatatccagtttactccctatcagtgatagagaacgtataagctttaggcgtgtacggtgggcgcctataaaagcagagctcgtttagtgaaccgtcagatcgcctggagcaattccacaacacttttgtcttataccaactttccgtaccacttcctaccctcgtaaaggtctagagctagcgaattcgaatttaaatctacgtagccaccatggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggctgctatcgtgccccagtcttttctcaaagatgattctattgataataaagtgttgacaagatccgataaagctagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttttgaaacccagctttcttgtacaaagtggttgatatcatctagagcggccgcaggtacctgaataactaaggccgcttccctttagtgagggttaatgcttcgagcagacaaagggttcgatccctaccggttagtaatgagtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctaggggcgcgccgtttaaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaggcgaccggctttgagaagttttagagctagaaatagcaagttaaaataaggctagtccgttatcaacttgaaaaagtggcaccgagtcggtgctttttttgtatacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgctgtggaagtctccaaacgcgttttagagctagaaatagcaagttaaaataaggctagtccgttatcaacttgaaaaagtggcaccgagtcggtgctttttttgttaacgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtcttctctctcggcgctatggttttagagctagaaatagcaagttaaaataaggctagtccgttatcaacttgaaaaagtggcaccgagtcggtgctttttttatttaaatagctagcttaattaaagctgaatctaagtggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagccgccatgtctagactggacaagagcaaagtcataaactctgctctggaattactcaatggagtcggtatcgaaggcctgacgacaaggaaactcgctcaaaagctgggagttgagcagcctaccctgtactggcacgtgaagaacaagcgggccctgctcgatgccctgccaatcgagatgctggacaggcatcatacccactcctgccccctggaaggcgagtcatggcaagactttctgcggaacaacgccaagtcataccgctgtgctctcctctcacatcgcgacggggctaaagtgcatctcggcacccgcccaacagagaaacagtacgaaaccctggaaaatcagctcgcgttcctgtgtcagcaaggcttctccctggagaacgcactgtacgctctgtccgccgtgggccactttacactgggctgcgtattggaggaacaggagcatcaagtagcaaaagaggaaagagagacacctaccaccgattctatgcccccacttctgaaacaagcaattgagctgttcgaccggcagggagccgaacctgccttccttttcggcctggaactaatcatatgtggcctggagaaacagctaaagtgcgaaagcggcgggccgaccgacgcccttgacgattttgacttagacatgctcccagccgatgcccttgacgactttgaccttgatatgctgcctgctgacgctcttgacgattttgaccttgacatgctccccggggagggcagaggaagtcttctaacatgcggtgacgtggaggagaatcccggccctgaattcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacaatcaacctctggattacaaaatttgtgggttaacttgtttattgcagcttataatggttacaaataaagcaatagcatcacaaatttcacaaataaagcatttttttcactgcattctagttgtggtttgtccaaactcatcaatgtatcttatcatgtctggaattgactcaaatgatgtcaattagtctatcagaagctatctggtctcccttccgggggacaagacatccctgtttaatatttaaacagcagtgttcccaaactgggttcttatatcccttgctctggtcaaccaggttgcagggtttcctgtcctcacaggaacgaagtccctaaagaaacagtggcagccaggtttagccccggaattgactggattccttttttagggcccattggtatggctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccctgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 124 - DNA, 10428 bp, Artificial Sequence
  PiggyBac-TRE-dCas9-VPR-polyA-sgRNA.lacZ-EF1a-rtTA-T2A-PuroR-polyA
ttaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttatgagggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaggcctccacggccactagttttactccctatcagtgatagagaacgtatgaagagtttactccctatcagtgatagagaacgtatgcagactttactccctatcagtgatagagaacgtataaggagtttactccctatcagtgatagagaacgtatgaccagtttactccctatcagtgatagagaacgtatctacagtttactccctatcagtgatagagaacgtatatccagtttactccctatcagtgatagagaacgtataagctttaggcgtgtacggtgggcgcctataaaagcagagctcgtttagtgaaccgtcagatcgcctggagcaattccacaacacttttgtcttataccaactttccgtaccacttcctaccctcgtaaaggtctagagctagcgaattcgaatttaaatctacgtagccaccatggacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggctgctatcgtgccccagtcttttctcaaagatgattctattgataataaagtgttgacaagatccgataaagctagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttttgaaacccagctttcttgtacaaagtggttgatatcatctagagcggccgcaggtacctgaataactaaggccgcttccctttagtgagggttaatgcttcgagcagacaaagggttcgatccctaccggttagtaatgagtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctagggagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtctgaccgatgatccgcgcgttttagagctagaaatagcaagttaaaataaggctagtccgttatcaacttgaaaaagtggcaccgagtcggtgctttttttttaattaaagctgaatctaagtggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctactctagagccgccatgtctagactggacaagagcaaagtcataaactctgctctggaattactcaatggagtcggtatcgaaggcctgacgacaaggaaactcgctcaaaagctgggagttgagcagcctaccctgtactggcacgtgaagaacaagcgggccctgctcgatgccctgccaatcgagatgctggacaggcatcatacccactcctgccccctggaaggcgagtcatggcaagactttctgcggaacaacgccaagtcataccgctgtgctctcctctcacatcgcgacggggctaaagtgcatctcggcacccgcccaacagagaaacagtacgaaaccctggaaaatcagctcgcgttcctgtgtcagcaaggcttctccctggagaacgcactgtacgctctgtccgccgtgggccactttacactgggctgcgtattggaggaacaggagcatcaagtagcaaaagaggaaagagagacacctaccaccgattctatgcccccacttctgaaacaagcaattgagctgttcgaccggcagggagccgaacctgccttccttttcggcctggaactaatcatatgtggcctggagaaacagctaaagtgcgaaagcggcgggccgaccgacgcccttgacgattttgacttagacatgctcccagccgatgcccttgacgactttgaccttgatatgctgcctgctgacgctcttgacgattttgaccttgacatgctccccggggagggcagaggaagtcttctaacatgcggtgacgtggaggagaatcccggccctgaattcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacaatcaacctctggattacaaaatttgtgggttaacttgtttattgcagcttataatggttacaaataaagcaatagcatcacaaatttcacaaataaagcatttttttcactgcattctagttgtggtttgtccaaactcatcaatgtatcttatcatgtctggaattgactcaaatgatgtcaattagtctatcagaagctatctggtctcccttccgggggacaagacatccctgtttaatatttaaacagcagtgttcccaaactgggttcttatatcccttgctctggtcaaccaggttgcagggtttcctgtcctcacaggaacgaagtccctaaagaaacagtggcagccaggtttagccccggaattgactggattccttttttagggcccattggtatggctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccctgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaa

SEQ ID NO: 125 - DNA, 23 bp, Artificial Sequence
  lacZ sgRNA
gtctgaccgatgatccgcgctgg

SEQ ID NO: 126 - DNA, 18 bp, Artificial Sequence
  sgOpn1mw_1_short
ggggcctttaaggtaagg

SEQ ID NO: 127 - DNA, 18 bp, Artificial Sequence
  sgOpn1mw_2_short
gccacccctgtggattgg

The invention claimed is:

1. A method of trans-activating a homologues gene of at least one gene of interest and optionally deactivation of at least one gene of interest, wherein the mRNA encoded by the at least one gene of interest comprises a mutation compared to a control, and wherein the method comprises the steps of:

binding of a complex comprising
    a native or genetically modified DNA-binding protein, wherein the native or genetically modified DNA-binding protein is a Cas-enzyme,
    at least one trans-activating domain of a transcriptional activator or transcription factor, and
    at least one guideRNA,
    wherein the at least one guideRNA binds to the promoter region of the homologous gene of the at least one gene of interest or to other elements regulating the expression of the mRNA encoded by the homologous gene of the at least one gene of interest, optionally wherein a further guideRNA binds to the coding region, the promoter region and/or to other elements regulating the expression of the mRNA encoded by the at least one gene of interest; and, wherein the at least one gene of interest is selected from the group consisting of opsin genes, cyclic nucleotide-gated channel (CNG) genes, retinal-specific ATP-binding cassette transporter (ABC transporter) genes and myosin genes; and wherein the homologous gene of the at least one gene of interest is selected from the group consisting of ABCA1, ABCA2, ABCA7, ABCA12, ABCA13, CNGA1, CNGA2, CNGA3, CNGA4, CNGB1, CNGB3, MYO7B, MYO5A, MYO5B, MYO5C, MYO10, MYO15B, MYO15A, OPN1LW, OP1MW and OPN1SW;

inducing the expression of the mRNA encoded by the homologous gene of the at least one gene of interest;

optionally deactivating the expression of the mRNA encoded by the at least one gene of interest; and thereby trans-activating the homologous gene of the at least one gene of interest.

2. The method according to claim 1, wherein the method further comprises inducing the expression of the protein encoded by the mRNA of the homologous gene of the at least one gene of interest and analyzing the sequence, the expression-level, the localization or the function of at least one protein encoded by the mRNA.

3. The method according to claim 1, wherein the homologous gene of the at least one gene of interest is selected from the group consisting of ABCA1 according to SEQ ID NO: 1, ABCA2 according to SEQ ID NO: 3, ABCA7 according to SEQ ID NO: 7, ABCA12 according to SEQ ID NO: 9, ABCA13 according to SEQ ID NO: 11, CNGA1 according to SEQ ID NO: 13, CNGA2 according to SEQ ID NO: 15, CNGA3 according to SEQ ID NO: 17, CNGA4 according to SEQ ID NO: 19, CNGB1 according to SEQ ID NO: 21, CNGB3 according to SEQ ID NO: 23, WYO7B according to SEQ ID NO: 33, MYO5A according to SEQ ID NO: 25, MYO5B according to SEQ ID NO: 27, MYO5C according to SEQ ID NO: 29, MWO10 according to SEQ ID NO: 35, MYO15B according to SEQ ID NO: 39, MYO15A according to SEQ ID NO: 37, OPN1LW according to SEQ ID NO: 41, OPN1MW according to SEQ ID NO: 43 and OPN1SW according to SEQ ID NO: 45.

4. The method according to claim 1, wherein the native or genetically modified DNA-binding protein is a Cas-enzyme selected from the group consisting of Cas9, dCas9-enzymes, Cas12a and Cas12b;

and/or wherein the at least one trans-activating domain of a transcriptional activator or transcription factor is selected from the group consisting of VPR, SAM, SunTag, VP64, p65, Rta and combinations thereof.

5. The method according to claim 4, wherein the nucleotide sequences of the native or genetically modified DNA-binding protein and of the at least one trans-activating domain of the transcriptional activator or transcription factor are on two separate plasmids and/or vectors.

6. The method of claim 4, wherein the native or genetically modified DNA-binding protein is a Cas-enzyme selected from the group consisting of Cas9 according to SEQ ID NO: 92, a dCas9-enzyme according to SEQ ID NO: 96 or SEQ ID NO: 97, Cas12a according to SEQ ID NO: 93 and Cas12b according to SEQ ID NO: 94; and/or wherein the at least one trans-activating domain of a transcriptional activator or transcription factor is selected from the group consisting of VPR according to SEQ ID NO: 89, SAM according to SEQ ID NO: 90, SunTag according to SEQ ID NO: 91, VP64 according to SEQ ID NO: 73, p65 according to SEQ ID NO: 74, Rta according to SEQ ID NO: 75 and combinations thereof.

7. The method of claim 4, wherein the nucleotide sequences of the native or genetically modified DNA-binding protein and of the at least one trans-activating domain of the transcriptional activator or transcription factor are separated in two split-fragments.

8. The method according to claim 1, wherein the method further comprises the use of recombinant AAV vectors of natural or engineered origin.

9. The method of claim 8, wherein the method comprises the use of AAV vector variants with retinal cell type tropism and enhanced retinal transduction efficiency.

10. A method of treating an inherited retinal dystrophy (IRD) due to a mutation in at least one gene of interest selected from the group consisting of opsin genes, cyclic nucleotide-gated channel (CNG) genes, retinal-specific ATP-binding cassette transporter (ABC transporter) genes and myosin genes, comprising administering a complex comprising a native or genetically modified DNA-binding protein, at least one trans-activating domain of a transcriptional activator or transcription factor and at least one guideRNA, wherein the method comprises trans-activating a homologous gene of the at least one gene of interest and optionally deactivation of the at least one gene of interest, wherein the at least one guideRNA binds to the promoter region of the homologous gene of the at least one gene of interest or to other elements regulating the expression of the mRNA encoded by the homologous gene of the at least one gene of interest, optionally wherein a further guideRNA binds to the coding region, the promoter region and/or to other elements regulating the expression of the mRNA encoded by the at least one gene of interest; and, wherein the expression of the mRNA encoded by the homologous gene of the at least one gene of interest is induced; and optionally the expression of the mRNA encoded by the at least one gene of interest is deactivated, wherein the complex is provided as nucleotide sequences of the native or genetically modified DNA-binding protein, the at least one trans-activating domain of a transcriptional activator or transcription factor and the at least one guide RNA, optionally wherein the nucleotide sequences of the native or genetically modified DNA-binding protein and of the at least one trans-activating domain of the transcriptional activator or transcription factor are on two separate plasmids and/or vectors, and wherein the native or genetically modified DNA-binding protein is a Cas-enzyme and the homologous gene of the at least one gene of interest is selected from the group consisting of ABCA1, ABCA2, ABCA7, ABCA12, ABCA13, CNGA1, CNGA2, CNGA3, CNGA4, CNGB1, CNGB3, MYO7B, MYO5A, MYO5B, MYO5C, MYO00, MYO15B, MYO15A, OPN1LW, OPN1MW and OPN1SW.

11. The method of claim 10, wherein the nucleotide sequence of the native or genetically modified DNA-binding protein and of the at least one trans-activating domain of the transcriptional activator or transcription factor are on two separate recombinant AAV vectors.

*  *  *  *  *